United States Patent 11,692,002 (RNA SEQUENCE ADAPTATION) - sequence listing, part 2

SEQ ID NO: 2701 - RNA, 1698 nt, Artificial Sequence
  derived and/or modified CDS sequence (AUadapt) from InfluenzaA__ACI32718__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggucguacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgccaccggggucuccgccucgugcucccacaacggcaagagcuccuucuaccgcaaccugcuguggcucaccgggaagaacggccuguaccccaaccugagcaaguccuacgccaacaacaaggagaaggaggugcucgugcuguggggcguccaccacccgcccaacaucggggaccagcgggcccuguaccacacggagaacgccuacgugagcguggucucgucccacuacagccgccgguucacccccgagaucgcgaagcgccccaaggugcgggaccaggagggccgcaucaacuacuacuggacccuccuggagcccggggacaccaucaucuucgaggccaacggcaaccugaucgccccgcgguucgccuucgcccucucccgcggguucggcagcggcaucaucacguccaacgcgcccauggacgagugcgacgccaagugccagacgccccagggggccaucaacucgucccugcccuuccagaacgugcacccggucaccaucggcgagugccccaaguacgugcggagcgccaagcugcgcauggccaccgggcuccggaacauccccuccauccagagccgcggccuguucggggcgaucgccggcuucaucgagggcggguggaccggcaugguggacgggugguacggcuaccaccaccagaacgagcagggguccggcuacgccgccgaccagaaguccacccagaacgccaucaacggcaucaccaacaaggucaacagcgugaucgagaagaugaacacccaguucacggcgguggggaaggaguucucgaagcuggagcggcgcauggagaaccucaacaagaaggucgacgacggcuuccuggacaucuggaccuacaacgccgagcugcucgugcugcuggagaacgagcggacccucgacuuccacgacuccaacgucaagaaccuguacgagaaggucaagagccagcugaagaacaacgccaaggagguggggaacggcugcuucgaguucuaccacaagugcaacgacgagugcauggaguccgugaagaacgggaccuacgacuaccccaaguacagcgaggaguccaagcucaaccgcgagaagaucgacggcgugaagcuggagagcaugggcguguaccagauccuggccaucuacucgacggucgccuccagccucgugcugcuggugucccucggggcgaucagcuucuggaugugcuccaacggcagccugcagugcaccaucugcaucuga

SEQ ID NO: 2702 - RNA, 1698 nt, Artificial Sequence; identical to SEQ ID NO: 2699
  derived and/or modified CDS sequence (AUadapt) from InfluenzaA__ACI32719__HA

SEQ ID NO: 2703 - RNA, 1698 nt, Artificial Sequence; identical to SEQ ID NO: 2699
  derived and/or modified CDS sequence (AUadapt) from InfluenzaA__ACI32720__HA

SEQ ID NO: 2704 - RNA, 1698 nt, Artificial Sequence
  derived and/or modified CDS sequence (AUadapt) from InfluenzaA__ACI32721__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccucguucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugucggucgugagcucccacuacagccgccgguucacccccgagaucgccaagcgccccaaggugcgggaccaggagggccgcaucuccuacuacuggacccuccuggagcccggggacaccaucaucuucgaggcgaacggcaaccugaucgccccgcgguucgccuucgcccucagccgcggguucggcuccggcaucaucacgagcaacgcccccauggacgagugcgacgcgaagugccagacgccccagggggccaucaacuccucgcugcccuuccagaacguccacccggugaccaucggcgagugccccaaguacgugcgguccgccaagcugcgcauggccaccgggcuccggaacauccccagcauccagucccgcggccuguucggggccaucgcgggcuucaucgagggcggguggaccggcauggucgacgggugguacggcuaccaccaccagaacgagcaggggagcggcuacgccgccgaccagaaguccacccagaacgccaucaacggcaucaccaacaaggugaacagcgugaucgagaagaugaacacccaguucacggccgucgggaaggaguucuccaagcuggagcggcgcauggagaaccucaacaagaagguggacgacggcuuccuggacaucuggaccuacaacgcggagcugcucguccugcuggagaacgagcggacccucgacuuccacgacagcaacgugaagaaccuguacgagaaggugaagucccagcugaagaacaacgccaaggagaucgggaacggcugcuucgaguucuaccacaagugcaacgacgagugcauggagucggucaagaacgggaccuacgacuaccccaaguacuccgaggagagcaagcucaaccgcgagaagaucgacggcgugaagcuggagagcaugggcguguaccagauccuggccaucuacuccacggucgccagcucccucgugcugcuggugagccucggggccaucuccuucuggaugugcagcaacggcucccugcagugccggaucugcaucuga

SEQ ID NO: 2705 - RNA, 1698 nt, Artificial Sequence; identical to SEQ ID NO: 2699
  derived and/or modified CDS sequence (AUadapt) from InfluenzaA__ACI32722__HA

SEQ ID NO: 2706 - RNA, 1698 nt, Artificial Sequence
  derived and/or modified CDS sequence (AUadapt) from InfluenzaA__ACI32723__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccucguucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugucggucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggucggccaagcugcgcauggccaccgggcuccggaacauccccuccauccagagccgcggccuguucggggccaucgcgggcuucaucgagggcggguggaccggcauggucgacgggugguacggcuaccaccaccagaacgagcagggguccggcuacgccgccgaccagaaguccacccagaacgccaucaacggcaucaccaacaaggugaacagcgugaucgagaagaugaacacccaguucacggccgucgggaaggaguucagcaagcuggagcggcgcauggagaaccucaacaagaagguggacgacggcuuccuggacaucuggaccuacaacgcggagcugcucguccugcuggagaacgagcggacccucgacuuccacgacuccaacgugaagaaccuguacgagaaggucaagagccagcugaagaacaacgccaaggagaucgggaacggcugcuucgaguucuaccacaagugcaacgacgagugcauggaguccgugaagaacgggaccuacgacuaccccaaguacucggaggaguccaagcucaaccgcgagaagaucgacggcgugaagcuggagagcaugggcguguaccagauccuggccaucuacagcacggucgccuccagccucgugcugcuggugucccucggggccaucagcuucuggaugugcuccaacggcagccugcagugccggaucugcuucuga

SEQ ID NO: 2707 - RNA, 1698 nt, Artificial Sequence
  derived and/or modified CDS sequence (AUadapt) from InfluenzaA__ACI32724__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccucgguguccagcuucgagcgguucgagaucuucccgaaggaguccagcuggcccaaccacaccgucaccgggguguccgccagcugcucccacaacggcaagucguccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacagccgccgguucacccccgagaucgccaagcgccccaaggugcgggaccaggagggccgcaucaacuacuacuggacccuccugaagcccggggacaccaucaucuucgaggcgaacggcaaccugaucgccccgcgguucgccuucgcccucucccgcggguucggcucgggcaucaucacguccaacgcccccauggacgagugcgacgcgaagugccagacgccccagggggccaucaacagcucccugcccuuccagaacguccacccggugaccaucggcgagugccccaaguacgugcggagcgccaagcugcgcauggccaccgggcuccggaacauccccuccauccagagccgcggccuguucggggccaucgcgggcuucaucgagggcggguggaccggcauggucgacgggugguacggcuaccaccaccagaacgagcagggguccggcuacgccgccgaccagaaguccacccagaacgccaucaacggcaucaccaacaaggugaacucggugaucgagaagaugaacacccaguucacggccgucgggaaggaguucagcaagcuggagcggcgcauggagaaccucaacaagaagguggacgacggcuuccuggacaucuggaccuacaacgcggagcugcucguccugcuggagaacgagcggacccucgacuuccacgacuccaacgugaagaaccuguacgagaaggucaagagccagcugaagaacaacgccaaggagaucgggaacggcugcuucgaguucuaccacaagugcaacgacgagugcauggaguccgugaagaacgggaccuacgacuaccccaaguacagcgaggaguccaagcucaaccgcgagaagaucgacggcgugaagcuggagucgaugggcguguaccagauccuggccaucuacagcacggucgccuccagccucgugcugcuggugucccucggggccaucagcuucuggaugugcuccaacggcagccugcagugcaagaucugcaucuga

SEQ ID NO: 2708 - RNA, 1698 nt, Artificial Sequence; identical to SEQ ID NO: 1630
  derived and/or modified CDS sequence (AUadapt) from InfluenzaA__ACI32725__HA

SEQ ID NO: 2709 - RNA, 1698 nt, Artificial Sequence
  derived and/or modified CDS sequence (AUadapt) from InfluenzaA__ACI32726__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccucgguguccagcuucgagcgguucgagaucuucccgaaggaguccagcuggcccaaccacaccgucaccgggguguccgccagcugcucccacaacggcaagucguccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcucgggcaucaucacguccaacgcccccauggacgagugcgacgcgaagugccagacgccccagggggccaucaacagcucccugcccuuccagaacguccacccggugaccaucggcgagugccccaaguacgugcggagcgccaagcugcgcauggccaccgggcuccggaacauccccuccauccagagccgcggccuguucggggccaucgcgggcuucaucgagggcggguggaccggcauggucgacgggugguacggcuaccaccaccagaacgagcagggguccggcuacgccgccgaccagaaguccacccagaacgccaucaacggcaucaccaacaaggugaacucggugaucgagaagaugaacacccaguucacggccgucgggaaggaguucagcaagcuggagaagcggauggagaaccucaacaagaagguggacgacggcuuccuggacaucuggaccuacaacgcggagcugcucguccugcuggagaacgagcgcacccucgacuuccacgacuccaacgugaagaaccuguacgagaaggucaagagccagcugaagaacaacgccaaggagaucgggaacggcugcuucgaguucuaccacaagugcaacgacgagugcauggaguccgugaagaacgggaccuacgacuaccccaaguacagcgaggaguccaagcucaaccgggagaagaucgacggcgugaagcuggagucgaugggcaucuaccagauccuggccaucuacagcacggugaccuccagccucguccugcuggugucccucggggccaucagcuucuggaugugcuccaacggcagccugcagugccgcaucugcaucuga

SEQ ID NO: 2710 - RNA, 1698 nt, Artificial Sequence
  derived and/or modified CDS sequence (AUadapt) from InfluenzaA__ACI32727__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccucgaucuccagcuucgagcgguucgagaucuucccgaaggaguccagcuggcccaaccacaccgugaccggggucuccgccagcugcucccacaacggcaagucguccuucuaccgcaaccugcuguggcucaccgggaagaacggccuguaccccaaccugagcaaguccuacgccaacaacaaggagaaggaggugcucgugcuguggggcguccaccacccgcccaacaucggggaccagcgggcccuguaccacacggagaacgccuacgugagcguggucagcucccacuacucgcgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacgugcacccggucaccaucggcgagugccccaaguacgugcggagcgccaagcugcgcauggccaccgggcuccggaacauccccuccauccagucgcgcggccuguucggggccaucgcgggcuucaucgagggcggguggaccggcaugguggacgggugguacggcuaccaccaccagaacgagcagggguccggcuacgccgccgaccagaaguccacccagaacgccaucaacggcaucaccaacaaggucaacagcgugaucgagaagaugaacacccaguucacggccguggggaaggaguucagcaagcuggagcggcgcauggagaaccucaacaagaaggucgacgacggcuuccuggacaucuggaccuacaacgcggagcugcucgugcugcuggagaacgagcggacccucgacuuccacgacuccaacgucaagaaccuguacgagaaggucaagagccagcugaagaacaacgccaaggagaucgggaacggcugcuucgaguucuaccacaagugcaacgacgagugcauggaguccgugaagaacgggaccuacgacuaccccaaguacucggaggaguccaagcucaaccgcgagaagaucgacggcgugaagcuggagagcaugggcguguaccagauccuggccaucuacagcacgguggccuccagccucguccugcuggugacccucggggccaucuccuucuggaugugcagcaacggcucccugcagugcaccaucugcaucuga

SEQ ID NO: 2711 - RNA, 1698 nt, Artificial Sequence
  derived and/or modified CDS sequence (AUadapt) from InfluenzaA__ACI32729__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugauccccaaggagagcugguccuacaucguggagacccccaaccccgagaacggcacgugcuacccgggcuacuucgccgacuacgaggagcugcgcgagcagcucagcuccgugucguccuucgagcgguucgagaucuuccccaaggagagcuccuggcccaaccacaccgucaccggggugagcgccuccugcagccacaacggcaaguccucguucuaccgcaaccugcuguggcucaccgggaagaacggccuguaccccaaccuguccaagagcuacgccaacaacaaggagaaggaggugcucguccuguggggcgugcaccacccgcccaacaucggggaccagcgggcccuguaccacacggagaacgccuacguguccgucgugagcagccacuacucccgccgguucacccccgagaucgccaagcgccccaaggugcgggaccaggagggccgcaucaacuacuacuggacccuccuggagccgggggacaccaucaucuucgaggcgaacggcaaccugaucgcgccccgguucgccuucgcccucucgcgcggguucggcuccggcaucaucacgagcaacgcccccauggacgagugcgacgccaagugccagacgccccagggggccaucaacuccagccugccguuccagaacguccaccccgugaccaucggcgagugccccaaguacgugcgguccgccaagcugcgcauggucaccgggcuccggaacauccccagcauccagucccgcggccuguucggggccaucgccggcuucaucgagggcggguggaccggcaugguggacgggugguacggcuaccaccaccagaacgagcaggggucgggcuacgcggccgaccagaaguccacccagaacgccaucaacggcgugaccaacaaggucaacagcgugaucgagaagaugaacacccaguucacggccgucgggaaggaguucaacaagcuggagcggcgcauggagaaccucaacaagaagguggacgacggcuuccuggacaucuggaccuacaacgccgagcugcucgugcugcuggagaacgagcggacccucgacuuccacgacuccaacgucaagaaccuguacgagaaggucaagagccagcugaagaacaacgcgaaggagaucgggaacggcugcuucgaguucuaccacaagugcaacgacgagugcauggaguccgugaagaacgggaccuacgacuacccgaaguacagcgaggaguccaagcucaaccgcgagaagaucgacggcgugaagcuggagucgaugggcguguaccagauccuggccaucuacuccacgguggccagcagccucguccugcuggugucccucggggccaucagcuucuggaugugcuccaacggcagccugcagugccggaucugcaucuga

SEQ ID NO: 2712 - RNA, 1698 nt, Artificial Sequence; identical to SEQ ID NO: 2711
  derived and/or modified CDS sequence (AUadapt) from InfluenzaA__ACI32730__HA

SEQ ID NO: 2713 - RNA, 1698 nt, Artificial Sequence
  derived and/or modified CDS sequence (AUadapt) from InfluenzaA__ACI32731__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccucgugcucccacaacggcaagagcuccuucuacaagaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugucggucgugagcucccacuacagccgcaaguucaaccccgagaucgccaagcggcccaaggugcgcgaccaggagggccggaucaacuacuacuggacgcuccuggagcccggggacaccaucaucuucgaggcgaacggcaaccugaucgccccgcgcuacgccuucgcccucucccggggguucggcagcggcaucaucaacuccaacgcccccauggacgagugcgacgcgaagugccagacgccccagggggccaucaacucgucccugcccuuccagaacguccacccggugaccaucggcgagugccccaaguacgugcgcagcgccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacucggucaucgagaagaugaacacgcaguucaccgccguggggaaggaguucaacaagcuggagcgccggauggagaaccucaacaagaaggucgacgacggcuucaucgacaucuggaccuacaacgccgagcugcuggugcuccuggagaacgagcgcacccuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggacguacgacuaccccaaguacuccgaggagagcaagcugaaccgggagaagaucgacggcgugaagcucgaguccaugggcgucuaccagauccuggccaucuacucgaccguggccagcucccuggugcuccuggucagccugggggccaucuccuucuggaugugcagcaacggcucccuccagugcaagaucugcaucuga

SEQ ID NO: 2714 - RNA, 1698 nt, Artificial Sequence
  derived and/or modified CDS sequence (AUadapt) from InfluenzaA__ACI32732__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccucguucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugucggucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggucggccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacccaguucacggccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacgugaagaaccuguacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagucgaagcucaaccgcgagaagaucgacggcgugaagcuggaguccaugggcgucuaccagauccuggccaucuacagcacgguggccagcucccucgugcugcuggucagccucggggccaucuccuucuggaugugcagcaacggcucccugcagugcaccaucugcaucuga

SEQ ID NO: 2715 - RNA, 1698 nt, Artificial Sequence
  derived and/or modified CDS sequence (AUadapt) from InfluenzaA__ACI32733__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccucgugcucccacaacggcaagagcuccuucuacaagaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugagcgucgugucgucccacuacagccgcaaguucaacuccgagaucgccaagcggcccaaggugcgcgaccaggagggccggaucaacuacuacuggacgcuccuggagcccggggacaccaucaucuucgaggcgaacggcaaccugaucgcgccccgcuacgccuucgcccucagccggggguucggcuccggcaucaucaacucgaacgccccgauggacgagugcgacgccaagugccagacgccccagggggccaucaacuccagccugcccuuccagaacguccaccccgugaccaucggcgagugcccgaaguacgugcgcuccgccaagcugcggauggucaccgggcuccgcaacauccccagcauccagucccggggccuguucggggccaucgccggcuucaucgagggcggguggaccggcaugguggacgggugguacggcuaccaccaccagaacgagcaggggagcggcuacgcggccgaccagaaguccacccagaacgccaucaacggcaucaccaacaaggugaacucggucaucgagaagaugaacacgcaguucaccgccguggggaaggaguucaacaagcuggagcgccggauggagaaccucaacaagaaggucgacgacggcuucaucgacaucuggaccuacaacgccgagcugcuggugcuccuggagaacgagcgcacccuggacuuccacgacuccaacgugaagaaccucuacgagaaggucaagagccagcugaagaacaacgcgaaggagaucgggaacggcugcuucgaguucuaccacaagugcaacgacgagugcauggaguccgugaagaacgggacguacgacuaccccaaguacagcgaggaguccaagcugaaccgggagaagaucgacggcgugaagcucgagagcaugggcgucuaccagauccuggccaucuacucgaccguggccuccagccuggugcuccuggucucccugggggccaucagcuucuggaugugcuccaacggcagccuccagugcaccaucugcaucuga

SEQ ID NO: 2716 - RNA, 1698 nt, Artificial Sequence
  derived and/or modified CDS sequence (AUadapt) from InfluenzaA__ACI32734__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccucguucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaagaagaaggaggugcucguccuguggggcgugcaccacccgcccaacaucggggaccagaaggcccuguaccacacggagaacgccuacgugucggucgugagcucccacuacagccggcgcuucacccccgagaucgccaagcggcccaaggugcgcgaccaggagggccggaucaacuacuacuggacccuccuggagcccggggacaccaucaucuucgaggcgaacggcaaccugaucgccccgcgcuucgccuucgcccucucccggggguucggcagcggcaucaucacguccaacgcccccauggacgagugcgacgcgaagugccagacgccccagggggccaucaacagcucccugcccuuccagaacguccacccggugaccaucggcgagugccccaaguacgugcgcucggccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacccaguucacggccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgugaagaaccuguacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagucgaagcucaaccgggagaagaucgacggcgugaagcuggaguccaugggcgucuaccagauccuggccaucuacagcacgguggccagcucccucgugcugcuggucagccucggggccaucuccuucuggaugugcagcaacggcucccugcagugcaccaucugcaucuga

SEQ ID NO: 2717 - RNA, 1698 nt, Artificial Sequence
  derived and/or modified CDS sequence (AUadapt) from InfluenzaA__ACI32736__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagccgcgaguccuggucguacaucguggagaagcccaaccccgagaacgggaccugcuaccccggccacuucgccgacuacgaggagcugcgggagcagcucuccagcguguccagcuucgagcgcuucgagaucuucccgaaggaguccucguggcccaaccacacggccaccggggucuccgccagcugcucccacaacggcaagagcuccuucuacaagaaccugcuguggcucaccgggaagaacggccuguaccccaaccugucgaaguccuacgccaacaacaaggagaaggaggugcucgugcuguggggcguccaccacccgcccaacaucggcgaccagcgggcccuguaccacaccgagaacgccuacgugagcguggucagcucccacuacucgcgcaaguucacgcccgagaucgcgaagcggcccaaggugcgcgaccaggagggccggaucaacuacuacuggacccuccuggagcccggggacaccaucaucuucgaggccaacggcaaccugaucgccccgcgcuacgccuucgcccucucccggggguucggcagcggcaucaucaacuccaacgcgcccauggacgagugcgacgccaagugccagacgccccagggggccaucaacagcucccugcccuuccagaacgugcacccggucaccaucggcgagugccccaaguacgugcgcucggccaagcugcggauggugaccgggcuccgcaacauccccuccauccagagccggggccuguucggggccaucgcgggcuucaucgagggcggguggaccggcauggucgacgggugguacggcuaccaccaccagaacgagcagggguccggcuacgccgccgaccagaaguccacccagaacgccaucaacggcaucacgaacaaggugaacagcgugaucgagaagaugaacacccaguucaccgccgucgggaaggaguucaacaagcuggagcgccggauggagaaccucaacaagaagguggacgacggcuucaucgacaucuggaccuacaacgcggagcugcugguccuccuggagaacgagcgcacgcuggacuuccacgacucgaacgugcggaaccucuacgagaaggugaagucccagcugaagaacaacgccaaggagaucgggaacggcugcuucgaguucuaccacaagugcaacgacgagugcauggagagcgucaagaacgggaccuacgacuaccccaaguacuccgaggagagcaagcugaaccgcgagaagaucgacggcgugaagcucgaguccaugggcguguaccagauccuggccaucuacucgaccgucgccagcucccuggugcuccuggugagccugggggccaucuccuucuggaugugcagcaacggcucccuccagugccggaucugcaucuga

SEQ ID NO: 2718 - RNA, 1698 nt, Artificial Sequence
  derived and/or modified CDS sequence (AUadapt) from InfluenzaA__ACI32737__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugauccccaaggagagcugguccuacaucguggagauccccaaccccgagaacgggaccugcuacccgggcuacuucgccgacuacgaggagcugcgcgagcagcucagcuccgugucguccuucgagcgguucgagaucuuccccaaggagagcuccuggcccaaccacacggucaccggggugagcgccuccugcagccacaacggcaaguccucguucuaccgcaaccugcuguggcucaccgggaagaacggccuguaccccaaccuguccaagagcuacgccaacaacaaggagaaggaggugcucguccuguggggcgugcaccacccgcccaacaucggcgaccagcgggcccuguaccacaccgagaacgccuacguguccgucgugagcagccacuacucccgccgguucacgcccgagaucgccaagcgccccaaggugcgggaccaggagggccgcaucaacuacuacuggacccuccuggagccgggggacaccaucaucuucgaggcgaacggcaaccugaucgcgccccgguucgccuucgcccucucgcgcgggcugggcuccggcaucaucaccagcaacgcccccauggacgagugcgacgccaagugccagacgccccagggggccaucaacuccagccugccguuccagaacguccaccccgugaccaucggcgagugccccaaguacgugcgguccgccaagcuccgcauggucaccgggcugcggaacauccccagcauccagucccgcggccuguucggggccaucgccggcuucaucgagggcggguggaccggcaugguggacgggugguacggcuaccaccaccagaacgagcaggggucgggcuacgcggccgaccagaaguccacgcagaacgccaucaacggcaucaccaacaaggugaacagcgucaucgagaagaugaacacccaguucaccgccguggggaaggaguucaacaagcucgagcggcgcauggagaaccugaacaagaaggucgacgacggcuuccuggacaucuggacguacaacgccgagcuccuggugcugcucgagaacgagcggacccuggacuuccacgacuccaacgugaagaaccuguacgagaaggucaagagccagcuccgcaacaacgcgaaggagaucgggaacggcugcuucgaguucuaccacaagugcaacgacgagugcauggaguccgugaagaacgggaccuacgacuacccgaaguacagcgaggaguccaagcugaaccgggagaagaucgacggcgugaagcuggagucgaugggcgucuaccagauccucgccaucuacuccaccguggccagcagccuggugcugcucgucucccugggggccaucagcuucuggaugugcuccaacggcagccugcagugccgcaucugcaucuga

SEQ ID NO: 2719 - RNA, 1698 nt, Artificial Sequence
  derived and/or modified CDS sequence (AUadapt) from InfluenzaA__ACI32739__HA
augaaggugaagcugcucauccugcugugcaccuucaccgccacguacgccgacaccaucugcaucggcuaccacgcgaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccucguucgagcgguucgagaucuucccgaaggaguccagcuggcccaaccacaccgugaccggggucuccgccagcugcucccacaacggcaagagcuccuucuaccgcaaccugcuguggcucaccgggaagaacggccuguaccccaaccugagcaaguccuacgccaacaacaaggagaaggaggugcucauccuguggggcgugcaccacccgcccaacaucgggaaccagcggacgcuguaccacaccgagaacgccuacgucucgguggugagcucccacuacagccgccgguucacccccgagaucaccaagcgccccaagguccgggaccaggagggccgcaucaacuacuacuggacgcuccuggagcccggggacaccaucaucuucgaggccaacggcaaccugaucgccccgugguacgcguucgcccucucccggggguucggcagcggcaucaucaccuccaacgcccccauggacgagugcgacgccaagugccagacgccccagggggccaucaacagcucccugcccuuccagaacgugcacccggugaccaucggcgagugccccaaguacguccgcucggcgaagcugcggauggugaccgggcuccgcaacauccccuccauccagagccggggccuguucggggccaucgccggcuucaucgagggcggguggaccggcaugguggacgggugguacggcuaccaccaccagaacgagcagggguccggcuacgccgccgaccagaaguccacccagaacgcgaucaacggcaucacgaacaaggucaacagcgugaucgagaagaugaacacccaguucaccgccguggggaaggaguucaacaagcuggagcgccggauggagaaccucaacaagaaggucgacgacggcuuccuggacaucuggaccuacaacgccgagcugcucgugcugcuggagaacgagcgcacgcucgacuuccacgacagcaacgucaagaaccuguacgagaaggugaagucccagcugaagaacaacgccaaggagaucgggaacggcugcuucgaguucuaccacaagugcaacaacgagugcauggagagcgugaagaacgggaccuacgacuaccccaaguacuccgaggagucgaagcucaaccgggagaagaucgacggcgucaagcuggaguccaugggcguguaccagauccuggccaucuacagcaccguggcgagcucccucguccugcuggugagccucggggccaucuccuucuggaugugcagcaacggcucccugcagugcaagaucugcaucuga

SEQ ID NO: 2720 - RNA, 1698 nt, Artificial Sequence
  derived and/or modified CDS sequence (AUadapt) from InfluenzaA__ACI32740__HA
augaaggugaagcugcucauccugcugugcaccuucaccgccacguacgccgacaccaucugcaucggcuaccacgcgaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcgccugcuaccccggcuacuucgccgacuacgaggagcugcgcgagcagcucuccucgguguccagcuucgagcgguucgagaucuucccgaaggaguccagcuggcccaagcacacggugaccggggucuccgccagcugcucccacaacggcaagucguccuucuaccgcaaccugcuguggcucaccgggaagaacggccuguaccccaaccugagcaaguccuacgccaacaacaaggagaaggaggugcucauccuguggggcgugcaccacccgcccaacaucggggaccagcggacccuguaccacacggagaacgccuacgucagcguggugagcucccacuacucgcgccgguucacccccgagaucaccaagcgccccaagguccgggaccaggagggccgcaucaacuacuacuggacccuccuggagcccggggacacgaucaucuucgaggccaacggcaaccugaucgcgccgugguacgccuucgcccucucccggggguucggcagcggcaucaucaccuccaacgcccccauggacgagugcgacgccaagugccagacgccccagggggcgaucaacagcucccugcccuuccagaacgugcacccggugaccaucggcgagugccccaaguacguccgcagcgccaagcugcggauggugaccgggcuccgcaacauccccuccauccagucgcggggccuguucggggccaucgccggcuucaucgagggcggguggaccggcaugguggacgggugguacggcuaccaccaccagaacgagcagggguccggcuacgccgcggaccagaaguccacccagaacgccaucaacggcaucaccaacaaggucaacagcgugaucgagaagaugaacacgcaguucaccgccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgucaagaaccuguacgagaaggugaagucccagcugaagaacaacgccaaggagaucgggaacggcugcuucgaguucuaccacaagugcaacaacgagugcauggagagcgugaagaacgggacguacgacuaccccaaguacuccgaggagucgaagcucaaccgggagaagaucgacggcgucaagcuggacuccaugggcguguaccagauccuggcgaucuacagcaccguggccagcucccucguccugcuggugagccucggggccaucuccuucuggaugugcccgaacggcagccugcagugcaccaucugcaucuga

SEQ ID NO: 2721 - RNA, 1698 nt, Artificial Sequence
  derived and/or modified CDS sequence (AUadapt) from InfluenzaA__ACI32741__HA
augaaggugaagcugcucauccugcugugcaccuucaccgccacguacgccgacaccaucugcaucggcuaccacgcgaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcgccugcuaccccggcuacuucgccgacuacgaggagcugcgcgagcagcucuccucgguguccagcuucgagcgguucgagaucuucccgaaggaguccagcuggcccaagcacacggugaccggggucuccgccagcugcucccacaacggcaagucguccuucuaccgcaaccugcuguggcucaccgggaagaacggccuguaccccaaccugagcaaguccuacgccaacaacaaggagaaggaggugcucauccuguggggcgugcaccacccgcccaacaucggggaccagcggacccuguaccacacggagaacgccuacgucagcguggugagcucccacuacucgcgccgguucacccccgagaucaccaagcgccccaagguccgggaccaggagggccgcaucaacuacuacuggacccuccuggagcccggggacacgaucaucuucgaggccaacggcaaccugaucgcgccgugguacgccuucgcccucucccggggguucggcagcggcaucaucaccuccaacgcccccauggacgagugcgacgccaagugccagacgccccagggggcgaucaacagcucccugcccuuccagaacgugcacccggugaccaucggcgagugccccaaguacguccgcagcgccaagcugcggauggugaccgggcuccgcaacauccccuccauccagucgcggggccuguucggggccaucgccggcuucaucgagggcggguggaccggcaugguggacgggugguacggcuaccaccaccagaacgagcagggguccggcuacgccgcggaccagaaguccacccagaacgccaucaacggcaucaccaacaaggucaacagcgugaucgagaagaugaacacgcaguucaccgccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgucaagaaccuguacgagaaggugaagucccagcugaagaacaacgccaaggagaucgggaacggcugcuucgaguucuaccacaagugcaacaacgagugcauggagagcgugaagaacgggacguacgacuaccccaaguacuccgaggagucgaagcucaaccgggagaagaucgacggcgucaagcuggacuccaugggcguguaccagauccuggcgaucuacagcaccguggccagcucccucguccugcuggugagccucggggccaucuccuucuggaugugcccgaacggcagccugcagugcaagaucugcaucuga

SEQ ID NO: 2722 - RNA, 1698 nt, Artificial Sequence
  derived and/or modified CDS sequence (AUadapt) from InfluenzaA__ACI32742__HA
augaaggugaagcugcucauccugcugugcaccuucaccgccacguacgccgacaccaucugcaucggcuaccacgcgaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccucguucgagcgguucgagaucuucccgaaggaguccagcuggcccaaccacaccgugaccggggucuccgccagcugcucccacaacggcaagagcuccuucuaccgcaaccugcuguggcucaccgggaagaacggccuguaccccaaccugagcaaguccuacgccaacaacaaggagaaggaggugcucauccuguggggcgugcaccacccgcccaacaucggggaccagcggacgcuguaccacaccgagaacgccuacgucucgguggugagcucccacuacagccgccgguucacccccgagaucaccaagcgccccaagguccgggaccaggagggccgcaucaacuacuacuggacgcuccuggagcccggggacaccaucaucuucgaggccaacggcaaccugaucgccccgugguacgcguucgcccucucccggggguucggcagcggcaucaucaccuccaacgcccccauggacgagugcgacgccaagugccagacgccccagggggccaucaacagcucccugcccuuccagaacgugcacccggugaccaucggcgagugccccaaguacguccgcucggcgaagcugcggauggugaccgggcuccgcaacauccccuccauccagagccggggccuguucggggccaucgccggcuucaucgagggcggguggaccggcaugguggacgggugguacggcuaccaccaccagaacgagcagggguccggcuacgccgccgaccagaaguccacccagaacgcgaucaacggcaucacgaacaaggucaacagcgugaucgagaagaugaacacccaguucaccgccguggggaaggaguucaacaagcuggagcgccggauggagaaccucaacaagaaggucgacgacggcuuccuggacaucuggaccuacaacgccgagcugcucgugcugcuggagaacgagcgcacgcucgacuuccacgacagcaacgucaagaaccuguacgagaaggugaagucccagcugaagaacaacgccaaggagaucgggaacggcugcuucgaguucuaccacaagugcaacaacgagugcauggagagcgugaagaacgggaccuacgacuaccccaaguacuccgaggagucgaagcucaaccgggagaagaucgacggcgucaagcuggacuccaugggcguguaccagauccuggccaucuacagcaccguggcgagcucccucguccugcuggugagccucggggccaucuccuucuggaugugcagcaacggcucccugcagugcaagaucugcaucuga

SEQ ID NO: 2723 - RNA, 1698 nt, Artificial Sequence
  derived and/or modified CDS sequence (AUadapt) from InfluenzaA__ACI32743__HA
augaaggugaagcugcucauccugcugugcaccuucaccgccacguacgccgacaccaucugcaucggcuaccacgcgaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcgccugcuaccccggcuacuucgccgacuacgaggagcugcgcgagcagcucuccagcguguccucguucgagcgguucgagaucuucccgaagaaguccagcuggcccaaccacacggugaccggggucuccgccagcugcucccacaacggcaagagcuccuucuaccgcaaccugcuguggcucaccgggaagaacggccuguaccccaaccugagcaaguccuacgccaacaacaaggagaaggaggugcucauccuguggggcgugcaccacccgcccaacaucgggaaccagcggacccuguaccacacggagaacgccuacgucucgguggugagcucccacuacagccgccgguucacccccgagaucaccaagcgccccaagguccgggaccaggagggccgcaucaacuacuacuggacccuccuggagcccggggacacgaucaucuucgaggccaacggcaaccugaucgcgccgugguacgccuucgcccucucccggggguucggcagcggcaucaucaccuccaacgcccccauggacgagugcgacgccaagugccagacgccccagggggcgaucaacagcucccugcccuuccagaacgugcacccggugaccaucggcgagugccccaaguacguccgcucggccaagcugcggauggugaccgggcuccgcaacauccccuccauccagagccggggccuguucggggccaucgccggcuucaucgagggcggguggaccggcaugguggacgggugguacggcuaccaccaccagaacgagcagggguccggcuacgccgcggaccagaaguccacccagaacgccaucaacggcaucaccaacaaggucaacagcgugaucgagaagaugaacacgcaguucaccgccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgucaagaaccuguacgagaaggugaagucccagcugaagaacaacgccaaggagaucgggaacggcugcuucgaguucuaccacaagugcaacaacgagugcauggagagcgugaagaacgggacguacgacuaccccaaguacuccgaggagucgaagcucaaccgggagaagaucgacggcgucaagcuggacuccaugggcguguaccagauccuggcgaucuacagcaccguggccagcucccucguccugcuggugagccucggggccaucuccuucuggaugugcagcaacggcucccugcagugccgcaucugcaucuga

SEQ ID NO: 2724 - RNA, 1701 nt, Artificial Sequence
  derived and/or modified CDS sequence (AUadapt) from InfluenzaA__ACJ09818__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagguggaggucacgaacgccaccgagcuggugcagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgucccggacuacgcgucgcugcggucccucguggccagcuccggcacgcuggaguucaacaacgagucguucaacuggaccggggugacccagaacggcaccuccagcgccugcauccgccgguccaacaacucguucuucucccgccugaacuggcucacgcaccugaaguucaaguaccccgcccugaacgucaccaugcccaacaacgagaaguucgacaagcucuacaucuggggcgugcaccaccccgggaccgacaacgaccagaucuuccuguacgcgcaggccagcgggcggaucaccguguccacgaagcgcucgcagcagaccgucaucccgaacaucggcagccggccccgcgugcggaacauccccucccgcaucucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacgcccaacggcuccauccccaacgacaagccguuccagaacgucaaccgcaucaccuacggggccugcccccgguacgugaagcagaacacccugaagcucgcgaccggcaugcgcaacgugcccgagaagcagacgcgggggaucuucggcgccaucgccggguucaucgagaacggcugggagggcauggucgacgggugguacggcuuccgccaccagaacucggaggggaucggccaggccgccgaccugaaguccacccaggcggccaucgaccagaucaacgggaagcugaaccggcucaucggcaagaccaacgagaaguuccaccagaucgagaaggaguucagcgagguggagggccgcauccaggaccuggagaaguacguggaggacaccaagaucgaccugugguccuacaacgccgagcuccuggucgcccuggagaaccagcacacgaucgaccucaccgacucggagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacguguaccgcgacgaggcccucaacaaccgguuccagaucaaggggguggagcugaaguccggcuacaaggacuggauccuguggaucuccuucgccaugagcugcuuccuccugugcgucgcccugcucggcuucaucaugugggccugccagaaggggaacauccgcugcaacaucugcaucuga

SEQ ID NO: 2725 - RNA, 1683 nt, Artificial Sequence
  derived and/or modified CDS sequence (AUadapt) from InfluenzaA__ACJ67533__HA
auggaaaccaucagucugaucaccauccuccugguggucacggccuccaacgccgacaagaucugcaucggccaccagagcaccaacuccaccgagaccguggacacgcugaccgagaccaaugugcccgucacccacgcgaaggagcuccugcacacggagcacaacgggaugcugugcgccaccagccucggccacccgcugauccuggauacgugcaccaucgaggggcucguguacggcaaccccuccugcgaccugcugcucgaggggcgcgaguggagcuacaucguggagcgguccagugccgucaacgggaccugcuaccccggcaacguggagaaccuggaggagcugcgcacccucuucuccagcgccuccaguuaccagcggauccagaucuuccccgacaccaccuggaacgugacguacaccggcaccucccgcgccugcagcggcuccuuuuaccggagcaugcgcuggcugacccagaaguccggguucuacccgguccaggacgcgcaguacacgaacaaucggggcaagagcauccuguucgugugggggauccaccacccgcccaccuacgccgagcagaccaaccucuacauccgcaacgauaccacgaccuccgugaccaccgaggaccugaaccggacguucaagcccgucaucggcccccgcccccuggugaacggccuccaggggcggaucgacuacuacuggagugugcugaagcccggccagacccugcgcguccggagcaacgggaaccucaucgcccccugguacggccacgugcuguccggcgggagccacggccgcauccugaagaccgaucucaaguccgggagcugcgugguccagugccagaccgagaagggcgggcugaacuccacgcugccguuccacaacaucaguaaguacgccuucgggaccugccccaaguacgugcgggugaacucccucaagcuggcggucggccugcgcaacgugcccgcccggagcucccgcggccucuuuggcgccaucgccggguucaucgagggcggguggcccggccugguggccggcugguacggguuccagcacagcaacgaccagggcgucgggauggcggccgaucgggacuccacccagaaggccaucgacaagaucaccagcaaggugaacaacaucgucgacaagaugaacaagcaguacgagaucaucgaucacgaguucuccgagguggagacgcgccugaacaugaucaacaacaagaucgacgaccagauccaggaugugugggccuacaacgccgagcuccugguccugcucgagaaccagaagacccuggacgagcacgacgcgaacgugaauaaccuguacaacaaggugaagcgggcccucggcagcaacgccauggaggacgggaagggcugcuuugagcuguaccacaagugcgacgaccagugcauggagaccauccgcaacggcaccuauaaccgccggaaguaccgcgaggagucccggcuggagcgccagaagaucgagggggucaagcucgagagcgagcggaccuacaagauccugacgaucuacuccaccguggccagcucccuggugcucgccaugggcuucgcggccuuucuguucugggccaugagcaacgggagcugccgcugcaacaucugcaucuga

SEQ ID NO: 2726 - RNA, 1704 nt, Artificial Sequence
  derived and/or modified CDS sequence (AUadapt) from InfluenzaA__ACJ68607__HA
auggagaagaucgugcugcuccuggccaucgucucgcuggugaaguccgaccagaucugcaucggcuaccacgccaacaacucgaccgagcaggucgacaccaucauggagaagaacgugacggugacccacgcgcaggacauccucgagaagacccacaacgggaagcugugcgaccuggacggcgugaagccccucauccugggggacugcuccgucgccggcuggcugcucgggaacccgaugugcgacgaguucaucaacgugcccgaguggagcuacaucguggagaaggccaaccccgccaacgaccugugcuaccccggcaacuucaacgacuacgaggagcugaagcaccuccugucccgcaucaaccacuucgagaagauccagaucauccccaagucguccuggagcgaccacgaggccuccucgggcgucuccagcgcgugcccguaccaggggacccccuccuucuuccggaacgugguguggcugaucaagaagaacaacacguaccccaccaucaagcgcucguacaacaacaccaaccaggaggaccuccugauccuguggggcauccaccacuccaacgacgccgccgagcagaccaagcucuaccagaacccgacgaccuacaucagcgucgggaccuccacccugaaccagcggcuggugcccaagaucgccacgcgcucgaaggugaacggccaguccgggcggauggacuucuucuggaccauccucaagcccaacgacgcgaucaacuucgagagcaacggcaacuucaucgcccccgaguacgccuacaagaucgucaagaagggcgacucggccaucaugaaguccgagguggaguacgggaacugcaacaccaagugccagaccccgaucggcgccaucaacagcuccaugcccuuccacaacauccacccccugacgaucggggagugccccaaguacgucaagucgaacaagcuggugcucgcgaccggccugcgcaacuccccgcugcgggagcgccggcgcaagcggggccucuucggggccaucgccggcuucaucgagggcggguggcaggggaugguggacggcugguacggcuaccaccacagcaacgagcagggguccggcuacgccgccgacaaggagucgacccagaaggcgaucgacggggugaccaacaaggucaacuccaucaucgacaagaugaacacgcaguucgaggccgugggccgcgaguucaacaaccuggagcggcgcaucgagaaccugaacaagaagauggaggacggguuccucgacguguggaccuacaacgccgagcugcugguccucauggagaacgagcggacccuggacuuccacgacagcaacgugaagaaccuguacgacaagguccgccuccagcugcgggacaacgccaaggagcugggcaacggcugcuucgaguucuaccacaagugcgacaacgagugcauggaguccgugcgcaacgggaccuacgacuacccccaguacucggaggaggcccggcucaagcgcgaggagaucuccggcgugaagcuggagagcaucgggacguaccagauccuguccaucuacucgaccgucgcguccagccucgcccuggccaucaugguggccggccugucccucuggaugugcucgaacgggagccugcagugccggaucugcaucuga

SEQ ID NO: 2727 - RNA, 1704 nt, Artificial Sequence
  derived and/or modified CDS sequence (AUadapt) from InfluenzaA__ACJ68609__HA
auggagaagaucgugcugcuccuggccaucgucucgcuggugaaguccgaccagaucugcaucggcuaccacgccaacaacucgaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguucaucaacgugcccgaguggagcuacaucguggagaaggccaaccccgccaacgaccugugcuaccccgggaacuucaacgacuacgaggagcugaagcaccuccugucccggaucaaccacuucgagaagauccagaucauccccaagucguccuggagcgaccacgaggccuccucgggcgucuccagcgcgugcccguaccagggcacccccuccuucuuccgcaacgugguguggcugaucaagaagaacaacacguaccccaccaucaagcggucguacaacaacaccaaccaggaggaccuccugauccugugggggauccaccacuccaacgacgccgccgagcagaccaagcucuaccagaacccgacgaccuacaucagcgucggcaccuccacccugaaccagcgccuggugcccaagaucgccacgcggucgaaggugaacgggcaguccggccgcauggacuucuucuggaccauccucaagcccaacgacgcgaucaacuucgagagcaacgggaacuucaucgcccccgaguacgccuacaagaucgucaagaagggcgacucggccaucaugaaguccgagguggaguacggcaacugcaacaccaagugccagaccccgaucggggccaucaacagcuccaugcccuuccacaacauccacccccugacgaucggcgagugccccaaguacgucaagucgaacaagcuggugcucgcgaccgggcugcggaacuccccgcugcgcgagcggcgccggaagcgcggccucuucggcgccaucgccggguucaucgagggcggguggcagggcaugguggacgggugguacggcuaccaccacagcaacgagcagggcuccggguacgccgccgacaaggagucgacccagaaggcgaucgacggcgugaccaacaaggucaacuccaucaucgacaagaugaacacgcaguucgaggccguggggcgggaguucaacaaccuggagcgccggaucgagaaccugaacaagaagauggaggacggcuuccucgacguguggaccuacaacgccgagcugcugguccucauggagaacgagcgcacccuggacuuccacgacagcaacgugaagaaccuguacgacaagguccggcuccagcugcgcgacaacgccaaggagcuggggaacggcugcuucgaguucuaccacaagugcgacaacgagugcauggaguccgugcggaacggcaccuacgacuacccccaguacucggaggaggcccgccuccggcgcgaggagaucuccggggugaagcuggagagcaucggcacguaccagauccuguccaucuacucgaccgucgcguccagccucgcccuggccaucaugguggccgggcugucccucuggaugugcucgaacggcagccugcagugccgcaucugcaucuga

SEQ ID NO: 2728 - RNA, 1704 nt, Artificial Sequence
  derived and/or modified CDS sequence (AUadapt) from InfluenzaA__ACJ68610__HA
auggagaagaucgugcuguuccucgccaucgucucgcuggugaaguccgaccagaucugcaucggcuaccacgccaacaacagcaccgagcaggucgacaccaucauggagaagaacgugacggugacccacgcgcaggacauccuggagaagacccacaacgggaagcucugcgaccuggacggcgugaagccccugauccuccgcgacugcuccgucgccggguggcugcugggcaacccgaugugcgacgaguucaucaacgugcccgaguggucguacaucguggagaaggccaaccccgccaacgaccucugcuaccccgggaacuucaacgacuacgaggagcugaagcaccuccugucccggaucaaccacuucgagaagauccagaucauccccaagagcuccuggucggaccacgaggccuccagcggcgucuccucggcgugcccguaccagggcacccccuccuucuuccgcaacgugguguggcugaucaagaagaacaacacguaccccaccaucaagcggagcuacaacaacaccaaccaggaggaccugcucauccugugggggauccaccacuccaacgacgccgccgagcagaccaagcuguaccagaacccgacgaccuacaucucggucggcaccuccacccucaaccagcgccuggugcccaagaucgccacgcggagcaaggugaacgggcaguccggccgcauggacuucuucuggaccauccugaagcccaacgacgcgaucaacuucgagucgaacgggaacuucaucgcccccgaguacgccuacaagaucgucaagaagggcgacagcgccaucaucaaguccgagguggaguacggcaacugcaacaccaagugccagaccccgaucggggccaucaacucguccaugcccuuccacaacauccacccccucacgaucggcgagugccccaaguacgucaagagcaacaagcuggugcuggcgaccgggcuccggaacuccccgcugcgcgagcggcgccggaagcgcggccuguucggcgccaucgccggguucaucgagggcggguggcagggcaugguggacgggugguacggcuaccaccacucgaacgagcagggcuccggguacgccgccgacaaggagagcacccagaaggcgaucgacggcgugaccaacaaggucaacuccaucaucgacaagaugaacacgcaguucgaggccguggggcgggaguucaacaaccucgagcgccggaucgagaaccugaacaagaagauggaggacggcuuccuggacguguggaccuacaacgccgagcuccugguccugauggagaacgagcgcacccucgacuuccacgacucgaacgugaagaaccuguacgacaagguccggcugcagcuccgcgacaacgccaaggagcuggggaacggcugcuucgaguucuaccacaagugcgacaacgagugcauggaguccgugcggaacggcaccuacgacuacccccaguacagcgaggaggcccgccugaagcgggaggagaucuccggggugaagcucgagucgaucggcacguaccagauccuguccaucuacagcaccgucgcguccucgcuggcccucgccaucaugguggccgggcugucccuguggaugugcagcaacggcagccuccagugccgcaucugcaucuga

SEQ ID NO: 2729 - RNA, 1704 nt, Artificial Sequence
  derived and/or modified CDS sequence (AUadapt) from InfluenzaA__ACJ68611__HA
auggagaagaucgugcugcuccuggccaucgucucgcuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguucaucaacgugcccgaguggucguacaucguggagaaggccaaccccgccaacgaccugugcuaccccgggaacuucaacgacuacgaggagcugaagcaccuccugucccggaucaaccacuucgagaagauccagaucauccccaagagcuccuggucggaccacgaggccucccugggcgucagcuccgcgugcccguaccagggcaugcccucguucuuccgcaacgugguguggcucaucaagaagaacaacaccuaccccacgaucaagcgguccuacaacaacaccaaccaggaggaccugcugauccucugggggauccaccacagcaacgacgccgccgagcagaccaagcuguaccagaacccgaccacguacaucuccgucggcaccucgacccugaaccagcgccucgugcccaagaucgccacccgguccaaggugaacgggcagagcggccgcauggacuucuucuggacgauccugaagcccaacgacgcgaucaacuucgaguccaacgggaacuucaucgcccccgaguacgccuacaagaucgucaagaagggcgacagcgccaucaugaaguccgaggugggcuacgggaacugcaacaccaagugccagaccccgaucggcgccaucaacucgagcaugcccuuccacaacauccacccccugaccaucggggagugccccaaguacgugaaguccaacaagcucguccuggcgacgggccugcggaacucgccgcuccgcgagcggcgccggaagcgcggccuguucggggccaucgccggcuucaucgagggcggguggcaggggaugguggacggcugguacggcuaccaccacuccaacgagcaggggagcggcuacgccgccgacaaggaguccacccagaaggcgaucgacggggugaccaacaaggucaacucgaucaucgacaagaugaacacccaguucgaggccgugggccgggaguucaacaaccuggagcgccggaucgagaaccucaacaagaagauggaggacggguuccuggacguguggacguacaacgccgagcugcucguccugauggagaacgagcgcacccuggacuuccacgacuccaacgugaagaaccucuacgacaagguccggcugcagcugcgcgacaacgccaaggagcucggcaacggcugcuucgaguucuaccacaagugcgacgacgagugcauggagagcgugcggaacgggaccuacgacuacccccaguacuccgaggaggcccgccugaagcgggaggagaucucgggcgugaagcuggaguccaucgggaccuaccagauccucagcaucuacuccacggucgcgucgucccuggcccuggccaucaugguggccggccucagccuguggaugugcuccaacgggagccugcagugccgcaucugcaucuga

SEQ ID NO: 2730 - RNA, 1704 nt, Artificial Sequence
  derived and/or modified CDS sequence (AUadapt) from InfluenzaA__ACJ68612__HA
auggagaagaucgugcugcuccuggccaucgucucgcuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguucaucaacgugcccgaguggucguacaucguggagaaggccaaccccgccaacgaccugugcuaccccgggaacuucaacgacuacgaggagcugaagcaccuccugucccggaucaaccacuucgagaagauccagaucauccccaagagcuccuggccggaccacgaggccucguccggcgucagcuccgcgugccccuaccagggcacccccucguucuuccgcaacgugguguggcugaucaagaagaacaacacguacccgaccaucaagcgguccuacaacaacaccaaccaggaggaccuccugauccugugggggauccaccacagcaacaacgccgccgagcagaccaagcucuaccagaaccccacgaccuacaucuccgucggcaccucgacccugaaccugcgccucgugcccaagaucgccacgcgguccaaggugaacgggcagagcggccgcauggacuucuucuggaccauccugaagcccaacgacgcgaucaacuucgaguccaacgggaacuucaucgccccggaguacgccuacaagaucgucaagaagggcgacucggccaucaugaaguccgagguggaguacggcaacugcaacaccaagugccagacccccaucggggccaucaacagcucgaugcccuuccacaacauccacccccugacgaucggcgagugcccgaaguacgugaaguccaacaagcucguccuggcgaccgggcugcggaacagcccccuccgcgagcggcgccggaagcgcggccuguucggcgccaucgccggguucaucgagggcggguggcagggcaugguggacgggugguacggcuaccaccacuccaacgagcagggcucgggguacgccgccgacaaggaguccacccagaaggcgaucgacggcgugaccaacaaggucaacagcaucaucgacaagaugaacacgcaguucgaggccguggggcgggaguucaacaaccuggagcgccggaucgagaaccucaacaagaagauggaggacggcuuccuggacguguggaccuacaacgccgagcugcucguccugauggagaacgagcgcacccuggacuuccacgacuccaacgugaagaaccucuacgacaagguccggcugcagcugcgcgacaacgccaaggagcucgggaacggcugcuucgaguucuaccacaagugcgacaacgagugcauggagucggugcggaacggcaccuacgacuacccccaguacuccgaggaggcccgccugaagcgggaggagaucagcggggugaagcuggaguccaucggcgcguaccagauccucucgaucuacuccacggucgccagcucccuggcccuggccaucaugguggccgggcucucgcuguggaugugcuccaacggcagccugcagugccgcaucugcaucuga

SEQ ID NO: 2731 - RNA, 1704 nt, Artificial Sequence
  derived and/or modified CDS sequence (AUadapt) from InfluenzaA__ACJ68613__HA
auggagaagaucgugcuguuccucgccaucgucucgcacgugaaguccgaccagaucugcaucggcuaccacgccaacaacagcaccgagcaggucgacaccaucauggagaagaacgugacggugacccacgcgcaggacauccuggagaagacccacaacgggaagcugugcgaccucggcggggugaagccccugauccugcgcgacugcuccgucgccggcuggcuccuggggaacccgaugugcgacgaguucaucaacgugcccgaguggucguacaucguggagaaggccaaccccgccaacgaccugugcuaccccggcaacuucaacgacuacgaggagcucaagcaccuccugucccggaucaaccacuucgagaagauccagaucauccccaagagcuccuggucggaccacgaggccuccagcggcgucuccucggugugcccguaccaggggacccccuccuucuuccgcaacguggucuggcugaucaagaagaacaacacguaccccaccaucaagaaguccuacaacaacaccaaccaggaggaccugcugauccucuggggcauccaccacagcaacgacgcggccgagcagaccaagcuguaccagaacccgacgaccuacaucucgguggggaccuccacccugaaccagcggcucgugcccaagaucgccacgcgcagcaaggucaacggccaguccgggcggauggacuucuucuggaccauccugaagcccaacgacgccaucaacuucgagucgaacggcaacuucaucgcgcccgaguacgccuacaagaucgugaagaagggcgacagcgccaucaugaaguccgagguggaguacgggaacugcaacaccaagugccagaccccgaucggcgccaucaacucguccaugcccuuccacaacauccacccccugacgaucggggagugccccaaguacgucaagagcaacaagcucgugcuggccaccggccugcgcaacuccccgcuccgggagcgccggcgcaagcggggccuguucggggcgaucgccggcuucaucgagggcggguggcaggggaugguggacggcugguacggcuaccaccacucgaacgagcagggguccggcuacgccgccgacaaggagagcacccagaaggccaucgacggggucaccaacaaggugaacuccaucaucgacaagaugaacacgcaguucgaggcggugggccgcgaguucaacaaccuggagcggcgcaucgagaaccucaacaagaagauggaggacggguuccuggacgucuggaccuacaacgccgagcugcucgugcugauggagaacgagcggacccuggacuuccacgacucgaacgucaagaaccucuacgacaaggugcgccugcagcugcgggacaacgccaaggagcucggcaacggcugcuucgaguucuaccacaagugcgacaacgagugcauggaguccgugcgcaacgggaccuacgacuacccccaguacagcgaggaggcccggcugaagcgcgaggagaucuccggcgucaagcuggagucgaucgggacguaccagauccucuccaucuacagcaccguggccuccucgcuggcgcuggccaucaugguggccggccucucccuguggaugugcagcaacgggagccugcagugccggaucugcaucuga

SEQ ID NO: 2732 - RNA, 1707 nt, Artificial Sequence
  derived and/or modified CDS sequence (AUadapt) from InfluenzaA__ACJ68614__HA
auggagaagaucgugcugcuccuggccaucgucucgcuggugaaguccgaccagaucugcaucggcuaccacgccaacaacucgaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguuccugaacgugcccgaguggagcuacaucguggagaagaucaaccccgucaacgaccugugcuaccccgggaacuucaacgacuacgaggagcucaagcaccuccugucccggaucaaccacuucgagaagauccagaucauccccaagucguccuggagcgaccacgaggccuccucgggcguguccagcgccugcccguaccagggccgcuccucguucuuccggaacguggucuggcugaucaagaagaacaacaccuaccccacgaucaagcgcuccuacaacaacaccaaccaggaggaccugcuggugcucugggggauccaccaccccaacgacgccgcggagcagacccggcuguaccagaacccgaccacguacaucagcgugggcaccuccacccugaaccagcgccucguccccaagcuggccacccggucgaaggugaacgggcaguccggccgcauggaguucuucuggacgauccugaagcccaacgacgccaucaacuucgagagcaacgggaacuucaucgcccccgagaacgcguacaagaucgugaagaagggcgacucgaccaucaugaaguccgagcucgaguacggcaacugcaacaccaagugccagaccccgaucggggccaucaacagcuccaugcccuuccacaacauccacccccugacgaucggcgagugccccaaguacgucaagucgaaccggcuggugcucgccaccgggcugcgcaacuccccgcagggcgagcggcgccggaagaagcgcggccuguucggggccaucgccggcuucaucgagggcggguggcaggggaugguggacggcugguacggcuaccaccacagcaacgagcggggguccggcuacgcggccgacaaggagucgacccagaaggccaucgacggggucaccaacaaggugaacuccaucaucgacaagaugaacacgcaguucgaggccgugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacagcaacgucaagaaccuguacgacaaggugcgccugcagcuccgggacaacgcgaaggagcugggcaacggcugcuucgaguucuaccaccgcugcgacaacgagugcauggaguccgugcgcaacgggaccuacgacuacccccaguacucggaggaggcccggcugaagcgcgaggagaucuccggcgucaagcucgagagcaucgggacguaccagauccuguccaucuacucgaccguggccuccagccuggcccucgccaucaugguggcgggccugucccuguggaugugcucgaacgggagccuccagugccggaucugcaucuga

SEQ ID NO: 2733 - RNA, 1698 nt, Artificial Sequence
  derived and/or modified CDS sequence (AUadapt) from InfluenzaA__ACK99007__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccucgugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugucggucgugagcucccacuacagccggaaguucacgcccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacaagugcgacgcgaagugccagacgccccagggggccaucaacucgucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacucggucaucgagaagaugaacacccaguucaccgccguggggaaggaguucaacaagcuggagcggcgcauggagaaccucaacaagaaggucgacgacggcuucaucgacaucuggaccuacaacgccgagcugcuggugcuccuggagaacgagcggacgcuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgugaagcucgaguccaugggcgucuaccagauccuggccaucuacucgaccguggccagcucccuggugcuccuggucagccugggggccaucuccuucuggaugugcagcaacggcucccuccagugccggaucugcaucuga

SEQ ID NO: 2734 - RNA, 1698 nt, Artificial Sequence
  derived and/or modified CDS sequence (AUadapt) from InfluenzaA__ACK99008__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccucgugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugucggucgugagcucccacuacagccggaaguucacgcccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacaagugcgacgcgaagugccagacgccccagggggccaucaacucgucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacucggucaucgagaagaugaacacccaguucaccgccguggggaaggaguucaacaagcuggagcggcgcauggagaaccucaacaagaaggucgacgacggcuucaucgacaucuggaccuacaacgccgagcugcuggugcuccuggagaacgagcggacgcuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgugaagcucgaguccauggaggucuaccagauccuggccaucuacucgaccguggccagcucccuggugcuccuggucagccugggcgccaucuccuucuggaugugcagcaacgggucccuccagugccggaucugcaucuga

SEQ ID NO: 2735 - RNA, 1698 nt, Artificial Sequence
  derived and/or modified CDS sequence (AUadapt) from InfluenzaA__ACK99009__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccucguggcccaaccacacggucaccgggguguccgccagcugcucccacaacggcgagagcuccuucuaccgcaaccugcuguggcucaccgggaagaacggccuguaccccaaccugucgaaguccuacgccaacaacaaggagaaggaggugcucguccuguggggcgugcaccacccgcccaacaucggcgaccagaaggcccuguaccacaccgagaacgccuacgugagcgucgugagcucccacuacucgcggaaguucacgcccgagaucgccaagcgccccaaggugcgggaccaggagggccgcaucaacuacuacuggacccuccuggagcccggggacaccaucaccuucgaggcgaacggcaaccugaucgccccgcgguacgccuucgcccucucccgcggguucggcagcggcaucaucaacuccaacgcccccauggacaagugcgacgcgaagugccagacgccccagggggccaucaacagcucccugcccuuccagaacguccacccggugaccaucggcgagugccccaaguacgugcggucggccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacgcagaacgccaucaacggcaucaccaacaaggugaacagcgucaucgagaagaugaacacccaguucaccgccguggggaaggaguucaacaagcuggagcggcgcauggagaaccucaacaagaaggucgacgacggcuucaucgacaucuggacguacaacgccgagcugcuggugcuccuggagaacgagcggacccuggacuuccacgacucgaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgugaagcucgaguccaugggcgucuaccagauccuggccaucuacucgaccguggccagcucccuggugcuccuggucagccugggggccaucuccuucuggaugugcagcaacggcucccuccagugccggaucugcaucuga

SEQ ID NO: 2736 - RNA, 1698 nt, Artificial Sequence; identical to SEQ ID NO: 2733
  derived and/or modified CDS sequence (AUadapt) from InfluenzaA__ACK99011__HA

SEQ ID NO: 2737 - RNA, 1698 nt, Artificial Sequence
  derived and/or modified CDS sequence (AUadapt) from InfluenzaA__ACK99012__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccucgugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugucggucgugagcucccacuacagccggaaguucacgcccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacaagugcgacgcgaagugccagacgccccagggggccaucaacucgucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacucggucaucgagaagaugaacacccaguucaccgccguggggaaggaguucaacaagcuggagcggcgcauggagaaccucaacaagaaggucgacgacggcuucaucgacaucuggaccuacaacgccgagcugcuggugcuccuggagaacgagcggacgcuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgugaagcucgaguccaugggcgucuaccagauccuggccaucuacucgaccguggccagcucccuggugcuccugaucagccugggggccaucuccuucuggaugugcagcaacggcucccuccagugccggaucugcaucuga

SEQ ID NO: 2738 - RNA, 1698 nt, Artificial Sequence; identical to SEQ ID NO: 2733
  derived and/or modified CDS sequence (AUadapt) from InfluenzaA__ACK99013__HA

SEQ ID NO: 2739 - RNA, 1698 nt, Artificial Sequence
  derived and/or modified CDS sequence (AUadapt) from InfluenzaA__ACK99014__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccucgugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugucggucgugagcucccacuacagccggaaguucacgcccgagaucgccaagcgccccaaggugcgggaccaggagggccgcaucaacuacuacuggacccuccuggagcccggggacaccaucaucuucgaggcgaacggcaaccugaucgccccgcgguacgccuucacccucucccgcggguucggcagcggcaucaucaacuccaacgcccccauggacaagugcgacgccaagugccagacgccccagggggcgaucaacucgucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgccgcggaccagaaguccacgcagaacgccaucaacggcaucaccaacaaggugaacucggucaucgagaagaugaacacccaguucaccgccguggggaaggaguucaacaagcuggagcggcgcauggagaaccucaacaagaaggucgacgacggcuucaucgacaucuggacguacaacgccgagcugcuggugcuccuggagaacgagcggacccuggacuuccacgacagcaacgugaagaaccucuacgagaaggucaagucccagcugaagaacaacgccaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgugaagcucgaguccaugggcgucuaccagauccuggcgaucuacucgaccguggccagcucccuggugcuccuggucagccugggggccaucuccuucuggaugugcagcaacggcucccuccagugccggaucugcaucuga

SEQ ID NO: 2740 - RNA, 1698 nt, Artificial Sequence; identical to SEQ ID NO: 2733
  derived and/or modified CDS sequence (AUadapt) from InfluenzaA__ACK99016__HA

SEQ ID NO: 2741 - RNA, 1698 nt, Artificial Sequence; identical to SEQ ID NO: 2733
  derived and/or modified CDS sequence (AUadapt) from InfluenzaA__ACK99018__HA

SEQ ID NO: 2742 - RNA, 1698 nt, Artificial Sequence; identical to SEQ ID NO: 2733
  derived and/or modified CDS sequence (AUadapt) from InfluenzaA__ACK99023__HA

SEQ ID NO: 2743 - RNA, 1698 nt, Artificial Sequence
  derived and/or modified CDS sequence (AUadapt) from InfluenzaA__ACK99026__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccucgugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugucggucgugagcucccacuacagccggaaguucacgcccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacaagugcgacgcgaagugccagacgccccagggggccaucaacucgucccugcccuuccagaacguccacccgaucaccaucggcgagugccccaaguacgugcggagcgccaagcugcgcauggugaccgggcuccggaacauccccuccauccagagccgcggccuguucggggccaucgccggcuucaucgagggcggguggaccggcauggucgacgggugguacggcuaccaccaccagaacgagcagggguccggcuacgcggccgaccagaaguccacccagaacgccaucaacggcaucacgaacaaggugaacucggugaucgagaagaugaacacccaguucaccgccgucgggaaggaguucaacaagcuggagcggcgcauggagaaccucaacaagaagguggacgacggcuucaucgacaucuggaccuacaacgccgagcugcugguccuccuggagaacgagcggacgcuggacuuccacgacagcaacgugaagaaccucuacgagaaggugaagucccagcugaagaacaacgcgaaggagaucgggaacggcugcuucgaguucuaccacaagugcaacgacgagugcauggagagcgucaagaacgggaccuacgacuaccccaaguacuccgaggagagcaagcugaaccgcgagaagaucgacggcgugaagcucgaguccaugggcguguaccagauccuggccaucuacucgaccgucgccagcucccuggugcuccuggugagccugggggccaucuccuucuggaugugcagcaacggcucccuccagugccggaucugcaucuga

SEQ ID NO: 2744 - RNA, 1698 nt, Artificial Sequence; identical to SEQ ID NO: 2417
  derived and/or modified CDS sequence (AUadapt) from InfluenzaA__ACK99027__HA

SEQ ID NO: 2745 - RNA, 1698 nt, Artificial Sequence
  derived and/or modified CDS sequence (AUadapt) from InfluenzaA__ACK99028__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccucgugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugucggucgugagcucccacuacagccggaaguucacgcccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacaagugcgacgcgaagugccagacccccaagggggccaucaacucgucccugcccuuccagaacguccacccggugacgaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacucggucaucgagaagaugaacacccaguucaccgccguggggaaggaguucaacaagcuggagcggcgcauggagaaccucaacaagaaggucgacgacggcuucaucgacaucuggaccuacaacgccgagcugcuggugcuccuggagaacgagcggacgcuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgugaagcucgaguccaugggcgucuaccagauccuggccaucuacucgaccguggccagcucccuggugcuccuggucagccugggggccaucuccuucuggaugugcagcaacggcucccuccagugccggaucugcaucuga

SEQ ID NO: 2746 - RNA, 1698 nt, Artificial Sequence
  derived and/or modified CDS sequence (AUadapt) from InfluenzaA__ACK99029__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccucgugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugagcgucgugucgucccacuacagccggaaguucacgcccgagaucuccaagcgccccaaggugcgggaccaggagggccgcaucaacuacuacuggacccuccuggagcccggggacaccaucaucuucgaggccaacggcaaccugaucgcgccgcgguacgccuucgcccucagccgcggguucggcuccggcaucaucaacucgaacgcccccauggacaagugcgacgccaagugccagacgccccagggggcgaucaacuccagccugcccuuccagaacguccacccggugaccaucggcgagugccccaaguacgugcgguccgccaagcugcgcauggucaccgggcuccggaacauccccagcauccagucccgcggccuguucggggccaucgccggcuucaucgagggcggguggaccggcaugguggacgggugguacggcuaccaccaccagaacgagcaggggagcggcuacgccgcggaccagaaguccacccagaacgccaucaacggcaucacgaacaaggugaacucggucaucgagaagaugaacacccaguucaccgccguggggaaggaguucaacaagcuggagcggcgcauggagaaccucaacaagaaggucgacgacggcuucaucgacaucuggaccuacaacgccgagcugcuggugcuccuggagaacgagcggacgcuggacuuccacgacuccaacgugaagaaccucuacgagaaggucaagagccagcugaagaacaacgccaaggagaucgggaacggcugcuucgaguucuaccacaagugcaacgacgagugcauggaguccgugaagaacgggaccuacgacuaccccaaguacagcgaggaguccaagcugaaccgcgagaagaucgacggcgugaagcucgagagcaugggcgucuaccagauccuggcgaucuacucgaccguggccuccagccuggugcuccuggucucccugggggccaucagcuucuggaugugcuccaacggcagccuccagugccggaucugcaucuga

SEQ ID NO: 2747 - RNA, 1698 nt, Artificial Sequence; identical to SEQ ID NO: 2733
  derived and/or modified CDS sequence (AUadapt) from InfluenzaA__ACK99030__HA

SEQ ID NO: 2748 - RNA, 1698 nt, Artificial Sequence; identical to SEQ ID NO: 2733
  derived and/or modified CDS sequence (AUadapt) from InfluenzaA__ACK99031__HA

SEQ ID NO: 2749 - RNA, 1698 nt, Artificial Sequence; identical to SEQ ID NO: 2733
  derived and/or modified CDS sequence (AUadapt) from InfluenzaA__ACK99032__HA

SEQ ID NO: 2750 - RNA, 1698 nt, Artificial Sequence; identical to SEQ ID NO: 2733
  derived and/or modified CDS sequence (AUadapt) from InfluenzaA__ACK99033__HA

SEQ ID NO: 2751 - RNA, 1698 nt, Artificial Sequence
  derived and/or modified CDS sequence (AUadapt) from InfluenzaA__ACK99034__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccucgugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugucggucgugagcucccacuacagccggaaguucacgcccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcgacuucgggagcggcaucaucaacuccaacgcccccauggacaagugcgacgcgaagugccagacgccccagggcgccaucaacucgucccugcccuuccagaacguccacccggugaccaucggggagugccccaaguacgugcggagcgccaagcugcgcauggucaccggccuccggaacauccccuccauccagagccgcgggcuguucggcgccaucgccggguucaucgagggcggcuggaccgggaugguggacggcugguacggguaccaccaccagaacgagcagggcuccggguacgcggccgaccagaaguccacccagaacgccaucaacggcaucacgaacaaggugaacucggucaucgagaagaugaacacccaguucaccgccgugggcaaggaguucaacaagcuggagcggcgcauggagaaccucaacaagaaggucgacgacggguucaucgacaucuggaccuacaacgccgagcugcuggugcuccuggagaacgagcggacgcuggacuuccacgacagcaacgugaagaaccucuacgagaaggucaagucccagcugaagaacaacgcgaaggagaucggcaacgggugcuucgaguucuaccacaagugcaacgacgagugcauggagagcgugaagaacggcaccuacgacuaccccaaguacuccgaggagagcaagcugaaccgcgagaagaucgacggggugaagcucgaguccaugggcgucuaccagauccuggccaucuacucgaccguggccagcucccuggugcuccuggucagccugggcgccaucuccuucuggaugugcagcaacgggucccuccagugccggaucugcaucuga

SEQ ID NO: 2752 - RNA, 1698 nt, Artificial Sequence
  derived and/or modified CDS sequence (AUadapt) from InfluenzaA__ACK99035__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccgccuucgagcgguucgagaucuucccgaaggagagcuccuggcccaaccacacggucaccggggugagcgccuccugcucgcacaacggcgaguccagcuucuaccgcaaccugcuguggcucaccgggaagaacggccuguaccccaaccuguccaagagcuacgccaacaacaaggagaaggaggugcucguccuguggggcgugcaccacccgcccaacaucggcgaccagaaggcccuguaccacaccgagaacgccuacguguccgucgugucgagccacuacucccggaaguucacgcccgagaucagcaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacacccccauggacaagugcgacgccaagugccagacgccccagggggcgaucaacucgucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgccgcggaccagaaguccacgcagaacgccaucaacggcaucaccaacaaggugaacucggucaucgagaagaugaacacccaguucaccgccguggggaaggaguucaacaagcuggagcggcgcauggagaaccucaacaagaaggucgacgacggcuucaucgacaucuggacguacaacgccgagcugcuggugcuccuggagaacgagcggacccuggacuuccacgacagcaacgugaagaaccucuacgagaaggucaagucccagcugaagaacaacgccaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgugaagcucgaguccaugggcgucuaccagauccuggcgaucuacucgaccguggccagcucccuggugcuccuggucagccugggggccaucuccuucuggaugugcagcaacggcucccuccagugccggaucugcaucuga

SEQ ID NO: 2753 - RNA, 1701 nt, Artificial Sequence; identical to SEQ ID NO: 2583
  derived and/or modified CDS sequence (AUadapt) from InfluenzaA__ACK99421__HA

SEQ ID NO: 2754 - RNA, 1689 nt, Artificial Sequence
  derived and/or modified CDS sequence (AUadapt) from InfluenzaA__ACK99432__HA
auggccaucaucuaccugauccuccuguucaccgccgugcgcggcgaccagaucugcaucggguaccacgcgaacaacucgaccgagaagaucgacacgauccuggagcggaacgucaccgugacccacgccaaggacauccucgagaagacccacaacggcaagcugugcaagcugaacgggaucccgccccucgagcugggcgacugcuccaucgccggguggcugcucggcaaccccgagugcgaccgccugcugcgggugcccgaguggucguacaucauggagaaggagaacccccgcuacucccucugcuacccgggcagcuucaacgacuacgaggagcugaagcaccuccuguccucggucaagcacuucgagaaggugaagauccugcccaaggaccgguggacgcagcacaccaccaccgggggcuccauggccugcgccgugagcgggaagcccuccuucuuccgcaacauggucuggcugacgaccaagggccccaacuacccgguggcgcaggggucguacaacaacaccuccggcgagcagaugcucaucaucuggggcgugcaccaccccaacgacgaggccgagcagcgggcccuguaccagaaggucgggaccuacgugagcgccuccacgucgacccuguacaagcgcuccauccccgagaucgcggcccggcccaaggugaacggccucgggagccgcauggaguucuccuggacccugcuggacaugugggacaccaucaacuucgagucgacgggcaaccucgucgccccggaguacggcuucaagaucuccaagcgggggucgagcggcaucaugaagaccgaggggacccuggagaacugcgagaccaagugccagacgccccugggcgccaucaacaccacccuccccuuccacaacgugcacccccugaccaucggggagugcccgaaguacgugaaguccgagaagcugguccucgccacgggccugcgcaacgugccccagaucgagucgcggggccuguucggggcgaucgccggcuucaucgagggcggguggcaggggaugguggacggcugguacggcuaccaccacuccaacgaccaggggagcggcuacgccgccgacaaggaguccacccagaaggccuucgacgggaucaccaacaaggucaacucggugaucgagaagaugaacacccaguucgaggcggugggcaaggaguucuccaaccucgagaagcgccuggagaaccugaacaagaagauggaggacggguuccucgacgucuggacguacaacgccgagcugcuggugcucauggagaacgagcggacccuggacuuccacgacagcaacgugaagaaccuguacgacaagguccgcaugcagcuccgggacaacgugaaggagcugggcaacggcugcuucgaguucuaccacaagugcgacaacgagugcauggacuccgucaagaacgggaccuacgacuaccccaaguacgaggaggagucgaagcugaaccgcaacgagaucaagggcgugaagcucuccagcauggggguguaccagauccuggccaucuacgccaccgucgccggcucccugucgcucgcgaucaugauggccggcaucuccuucuggaugugcagcaacgggucccugcagugccggaucugcaucuga

SEQ ID NO: 2755 - RNA, 1701 nt, Artificial Sequence
  derived and/or modified CDS sequence (AUadapt) from InfluenzaA__ACK99443__HA
augaaggccaagcugcucgugcugcugugcgccuucaccgcgaccgacgccgacacgaucugcaucggcuaccacgccaacaacucgaccgacaccgucgacaccgugcucgagaagaacgugacggucacccacuccgugaaccugcuggaggacagccacaacgggaagcucugccgccugaagggcaucgcgccccugcagcucgggaacugcuccaucgccggcuggauccuggggaacccggagugcgagagccuguucuccaaggagucgugguccuacaucgccgagacccccaacagcgagaacgggaccugcuaccccggcuacuucgccgacuacgaggagcuccgggagcagcuguccagcguguccagcuucgagcgcuucgagaucuuccccaaggaguccucguggccgaaccacacggucaccaagggcgugaccgccgccugcucccacaacggcaagagcuccuucuaccggaaccugcucuggcugaccgagaagaacgggcuguaccccaaccucagcaaguccuacgugaacaacaaggagaaggagguccuggugcuguggggcgugcaccaccccagcaacaucggggaccagcgcgcgaucuaccacacggagaacgccuacgucucggugguguccagccacuacucccggcgcuucacccccgagaucgccaagcggccgaagguccgcggccaggagggccggaucaacuacuacuggacccuccuggagcccggggacaccaucaucuucgaggccaacggcaaccugaucgcccccugguacgcguucgcccucagccgcggguucggcuccggcaucaucacgucgaacgccuccauggacgagugcgacgccaagugccagacgccccagggggccaucaacagcucccugccguuccagaacgugcaccccgugaccaucggcgagugccccaaguacguccggagcaccaagcugcgcauggugaccgggcuccggaacauccccuccgugcagagccgcggccuguucggggcgaucgccggcuucaucgagggcggguggaccggcaugaucgacgggugguacggcuaccaccaccagaacgagcagggguccggcuacgccgccgaccagaaguccacccagaacgccaucaacggcaucaccaacaaggucaacucggugaucgagaagaugaacacgcaguucaccgcgguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacgucaagaaccuguacgagaaggugaagucccagcugaagaacaacgccaaggagaucgggaacggcugcuucgaguucuaccacaagugcaacaacgagugcauggagagcgugaagaacgggacguacgacuacccgaaguacuccgaggagagcaagcucaaccgcgagaagaucgacggcgucaagcuggagucgaugggcguguaccagauccuggccaucuacuccaccguggccagcucccucguccugcuggugagccucggggcgaucuccuucuggaugugcagcaacggcucccugcagugccggaucugcaucuga

SEQ ID NO: 2756 - RNA, 1701 nt, Artificial Sequence
  derived and/or modified CDS sequence (AUadapt) from InfluenzaA__ACK99465__HA
augaaggccaagcugcucgugcugcugugcgccuucaccgcgaccuacgccgacacgaucugcaucggcuaccacgccaacaacucgaccgacaccgucgacaccgugcucgagaagaacgugacggucacccacuccgugaaccugcuggaggacagccacaacgggaagcucugccgccugaagggcaccgcgccccugcagcucgggaacugcuccguggccggcuggauccuggggaacccggagugcgagagccuguucuccaaggagucgugguccuacaucgccgagaagcccaaccccgagaacgggaccugcuaccccggcuacuucgccgacuacgaggagcuccgggagcagcugagcuccgucagcuccuucgagcgcuucgagaucuucccgaaggagucguccuggcccaaccacacggugaccaagggcgugaccgccagcugcucccacaacggcaagagcuccuucuacaagaaccugcucuggcugaccaagaagaacgggcuguaccccaaccucucgaaguccuacgucaacaacaaggagaaggaggugcuggugcuguggggcguccaccaccccagcaacaucggggaccagcgggccaucuaccacacggagaacgcguacgugagcguggucuccagccacuacucccgccgguucaccccggagaucgccaagcgccccaaggugcgggaccaggagggccgcaucaacuacuacuggacccuccuggagcccggcgacaccaucaucuucgaggccaacgggaaccugaucgcccccugguacgccuucgcgcucucgcggggcuucggguccggcaucaucacgagcaacgccuccaugggcgagugcgacgccaagugccagaccccgcagggggccaucaacagcucccugcccuuccagaacgugcaccccgucaccaucggcgagugccccaaguacgugcgcucgaccaagcugcggauggugacggggcuccgcaacaucccguccauccagagccggggccuguucggggccaucgcgggcuucaucgagggcggguggaccggcaugaucgacgggugguacggcuaccaccaccagaacgagcagggguccggcuacgccgccgacaagaaguccacccagaacgccaucgacggcaucaccaacaaggucaacagcgugaucgagaagaugaacacgcaguucaccgccguggggaaggaguucaacaagcuggagcgccggauggagaaccucaacaagaaggucgacgacggcuuccuggacaucuggaccuacaacgcggagcugcucgugcugcuggagaacgagcgcacccucgacuuccacgacucgaacgucaagaaccuguacgagaaggugaagaaccagcugaagaacaacgccaaggagaucgggaacggcugcuucgaguucuaccacaagugcaacaacgagugcauggaguccgugaagaacgggacguacgacuaccccaaguacagcgaggaguccaagcucaagcgggagaagaucgacggcgucaagcuggagagcaugggcguguaccagauccuggccaucuacucgaccguggccuccagccucguccugcuggugucccucggggccaucagcuucuggaugugcuccaacggcagccugcagugccgcaucugcaucuga

SEQ ID NO: 2757 - RNA, 1701 nt, Artificial Sequence
  derived and/or modified CDS sequence (AUadapt) from InfluenzaA__ACK99476__HA
augaagaccaucaucgcccugucguacauccucugcaugguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccucgaccgggcgcaucugcgacagcccccaccggauccucgacggcaagaacugcacccugaucgacgcccugcucggggacccccacugcgacgacuuccagaacaaggagugggaccuguucguggagcgcucgaaggccuacuccaacugcuaccccuacgacgugccggacuacgcgagccugcggucccucgucgccucguccggcacgcuggaguucaacaacgagagcuucaacuggaccggcguggcccagaacgggaccuccuacgccugcaagcgccggucggugaaguccuucuucagccgccugaacuggcuccacaagcuggaguacaaguaccccgcgcugaacgucaccaugcccaacaacgacaaguucgacaagcucuacaucuggggcgugcaccacccccggacggacuccgaccagaccucgcuguacgugcaggccuccgggcgcgucaccgugagcaccaagcggucgcagcagacggugaucccgaacaucggcuccagccccuggguccgcgggguguccucgcggaucuccaucuacuggaccaucgugaagcccggcgacauccugcucaucaacagcaccggcaaccugaucgcgccccgcggguacuucaagauccgguccggcaagucguccaucaugcgcagcgacgccccgaucgggaacugcaacuccgagugcaucacccccaacggcucgauccccaacgacaagcccuuccagaacgucaaccggaucacguacggcgccugcccgcgcuacgugaagcagaacacccugaagcucgccaccgggaugcggaacgugcccgagaagcagacccgcggcaucuucggggccaucgccggcuucaucgagaacgggugggagggcauggucgacggcugguacggguuccggcaccagaacuccgagggcacggggcaggccgccgaccugaaguccacccaggcggccaucaaccagaucaacggcaagcugaaccgccucaucgagaagaccaacgagaaguuccaccagaucgagaaggaguucuccgagguggaggggcggauccaggaccuggagaaguacguggaggacaccaagaucgaccuguggagcuacaacgccgagcuccuggucgcccuggagaaccagcacacgaucgaccucaccgacuccgagaugaacaagcuguucgagcgcacccgcaagcagcugcgggagaacgccgaggacaugggcaacggcugcuucaagaucuaccacaagugcgacaacgcgugcaucgggucgauccgcaacggcaccuacgaccacgacguguaccgggacgaggcccucaacaaccgcuuccagaucaagggggucgagcugaaguccggcuacaaggacuggauccuguggaucagcuucgccaucagcugcuuccuccugugcguggugcugcucggguucaucaugugggccugccagaagggcaacauccggugcaacaucugcaucuga

SEQ ID NO: 2758 - RNA, 1698 nt, Artificial Sequence; identical to SEQ ID NO: 2159
  derived and/or modified CDS sequence (AUadapt) from InfluenzaA__ACL12063__HA

SEQ ID NO: 2759 - RNA, 1701 nt, Artificial Sequence
  derived and/or modified CDS sequence (AUadapt) from InfluenzaA__ACL12129__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcggcucgccccaccggauccuggacgggaagaacugcacccugaucgacgcccuccugggcgacccccacugcgacggcuuccagaacaaggagugggaccuguucguggagcgcagcaaggccuacuccaacugcuaccccuacgacgugccggacuacgcgucgcuccggucccuggucgccagcuccgggacgcuggaguucaucaacgaggacuucaacuggaccggcguggcccaggacgggggcucguacgccugcaagcgcggguccgugaacagcuucuucucccggcucaacuggcugcacaagcuggaguacaaguaccccgcgcucaacgucaccaugcccaacaacggcaaguucgacaagcuguacaucuggggcgugcaccaccccucgaccgacuccgaccagacgagccuguacgugcgcgccuccgggcgggucaccgugucgaccaagcgcucgcagcagaccgugacgccgaacaucggcucccggcccuggguccgcgggcagagcucccggaucucgaucuacuggaccaucgugaagcccggcgacauccuccugaucgacuccaccggcaaccugaucgcgccccgcggguacuucaagauccggaacggcaagagcuccaucaugcgcucggacgccccgaucgggaacugcuccagcgagugcaucacccccaacggcuccauccccaacgacaagcccuuccagaacgugaaccggaucacguacggggccugcccgcgcuacgucaagcagaacacccucaagcuggccaccggcaugcggaacgugcccgagaagcagacccgcggcaucuucggggccaucgccggcuucaucgagaacgggugggagggcaugguggacgggugguacggcuuccggcaccagaacucggagggcacggggcaggccgccgaccugaaguccacccaggcggccaucgaccagaucaacggcaagcucaaccgccugaucgagaagaccaacgagaaguuccagcagaucgagaaggaguucagcgaggucgaggggcggauccaggaccuggagaaguacguggaggacaccaagaucgaccucugguccuacaacgccgagcugcugguggcccucgagaaccagcacacgaucgaccugaccgacucggagaugaacaagcuguucgagaagacccgcaagcagcuccgcgagaacgccgaggacaugggcaacgggugcuucaagaucuaccacaagugcgacaacgcgugcaucggcuccauccggaacggcaccuacgaccacgacgucuaccgcgacgaggcccugaacaaccgguuccagaucaaggggguggagcugaaguccggcuacaaggacuggauccucuggaucuccuucgccaucagcugcuuccugcugugcgucgugcuccugggguucaucaugugggccugccagaagggcaacauccgcugcaacaucugcaucuga

SEQ ID NO: 2760 - RNA, 1701 nt, Artificial Sequence; identical to SEQ ID NO: 2601
  derived and/or modified CDS sequence (AUadapt) from InfluenzaA__ACL12140__HA

SEQ ID NO: 2761 - RNA, 1698 nt, Artificial Sequence; identical to SEQ ID NO: 2685
  derived and/or modified CDS sequence (AUadapt) from InfluenzaA__ACL12151__HA

SEQ ID NO: 2762 - RNA, 1701 nt, Artificial Sequence; identical to SEQ ID NO: 2679
  derived and/or modified CDS sequence (AUadapt) from InfluenzaA__ACL12162__HA

SEQ ID NO: 2763 - RNA, 1701 nt, Artificial Sequence
  derived and/or modified CDS sequence (AUadapt) from InfluenzaA__ACL12173__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccucggggcggaucaccguguccacgaagcgcagccagcagaccgugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggcggggccaggccgccgaccugaaguccacccaggcggccaucaaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 2764 - RNA, 1701 nt, Artificial Sequence
  derived and/or modified CDS sequence (AUadapt) from InfluenzaA__ACL12184__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccucggggcggaucaccguguccacgaagcgcagccagcagaccgugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggcggggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgcgagaacgccgaggacauggggaacggcugcuucaagaucuaccacaagugcgacaacgcgugcaucggguccauccgcaacggcaccuacaaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 2765 - RNA, 1701 nt, Artificial Sequence; identical to SEQ ID NO: 2679
  derived and/or modified CDS sequence (AUadapt) from InfluenzaA__ACL12195__HA

SEQ ID NO: 2766 - RNA, 1701 nt, Artificial Sequence
  derived and/or modified CDS sequence (AUadapt) from InfluenzaA__ACL12217__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccucggggcggaucaccguguccacgaagcgcagccagcagaccgugaucccgaacaucggcucgcggccccgcguccggaacauccccucccgcaucagcaucuacuggaccaucgugaagcccggcgacgugcugcucaucaacuccaccgggaaccugaucgccccgcggggcuacuucaagauccgcucggggaaguccucgaucaugcgguccgacgcccccaucggcaagugcaacagcgagugcaucacgcccaacggcuccauccccaacgacaagccguuccagaacgucaaccgcaucaccuacggggccugcccccgguacgugaagcagaacacccugaagcucgcgaccggcaugcgcaacgugcccgagaagcagacgcgggggaucuucggcgccaucgccggguucaucgagaacggcugggagggcauggucgacgggugguacggcuuccgccaccagaacucggaggggcggggccaggccgccgaccugaaguccacccaggcggccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcccuggagaaccagcacacgaucgaccucaccgacucggagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcccugcucggcuucaucaugugggccugccagaaggggaacauccggugcaacaucugcaucuga

SEQ ID NO: 2767 - RNA, 1701 nt, Artificial Sequence; identical to SEQ ID NO: 2679
  derived and/or modified CDS sequence (AUadapt) from InfluenzaA__ACL12228__HA

SEQ ID NO: 2768 - RNA, 1701 nt, Artificial Sequence; identical to SEQ ID NO: 2679
  derived and/or modified CDS sequence (AUadapt) from InfluenzaA__ACL12239__HA

SEQ ID NO: 2769 - RNA, 1701 nt, Artificial Sequence
  derived and/or modified CDS sequence (AUadapt) from InfluenzaA__ACL12250__HA
augaagaccaucaucgcccugucguacauccucugccugguguucgcccagaaguuccccggcaacgacaacuccaccgcgacgcugugccucgggcaccacgccgucccgaacggcaccaucgugaagaccaucaccaacgaccagaucgaggugacgaacgccaccgagcugguccagagcuccucgaccggggagaucugcgacagcccccaccagauccuggacggcgagaacugcacccucaucgacgcccugcugggggacccccagugcgacggcuuccagaacaagaacugggaccucuucguggagcgcucgaaggccuacuccaacugcuaccccuacgacgugccggacuacgucagccugcggucccugguggcgagcuccggcacgcucgaguucaacaacgagucguucaacuggaccggggugacccagaacggcaccuccagcgccugcauccgccgguccaacaacucguucuucucccgccugaacuggcugacgcacagcaaguucaaguaccccgcccucaacgucaccaugcccaacaacgagaacuucgacaagcuguacaucuggggcgugcaccaccccgggaccgacaacgaccagaucuuccuguacgcccaggcguccgggcggaucaccgugucgacgaagcgcagccagcagaccgucaucccgaacaucggcucccggccccgcgugcggaacauccccagccgcaucuccaucuacuggaccaucgugaagcccggcgacauccuccugaucaacucgaccgggaaccugaucgccccgcggggcuacuucaagauccgcuccgggaaguccuccaucaugcggagcgacgcccccaucggcaagugcaacuccgagugcaucacgcccaacggcucgauccccaacgacaagccguuccagaacgucaaccgcaucaccuacggggccugcccccgguacgugaagcagaacacccucaagcuggccaccggcaugcgcaacgugcccgagaagcagacgcgggggaucuucggcgcgaucgccggguucaucgagaacggcugggagggcauggucgacgggugguacggcuuccgccaccagaacuccgaggggaucggccaggccgccgaccucaagagcacccaggccgcgaucgaccagaucaacgggaagcugaaccggcugaucggcaagaccaacgagaaguuccaccagaucgagaaggaguucuccgagguggagggccgcauccaggaccuggagaaguacguggaggacaccaagaucgaccucuggucguacaacgccgagcugcuggucgcccucgagaaccagcacacgaucgaccugaccgacuccgagaugaacaagcuguucgagaagaccaagaagcagcuccgggagaacgccgaggacauggggaacggcugcuucaagaucuaccacaagugcgacaacgccugcaucgggagcauccgcaacggcaccuacgaccacgacguguaccgcgacgaggcgcugaacaaccgguuccagaucaaggggguggagcugaaguccggcuacaaggacuggauccucuggaucagcuucgccaucuccugcuuccugcugugcaucgcccuccugggcuucaucaugugggccugccagaaggggaacauccgcugcaacaucugcaucuga

SEQ ID NO: 2770 - RNA, 1701 nt, Artificial Sequence
  derived and/or modified CDS sequence (AUadapt) from InfluenzaA__ACL12261__HA
augaaggccaagcugcucgugcugcugugcgccuucaccgcgaccgacgccgacacgaucugcaucggcuaccacgccaacaacucgaccgacaccgucgacaccgugcucgagaagaacgugacggucacccacuccgugaaccugcuggaggacagccacaacgggaagcucugccgccugaagggcaucgcgccccugcagcucgggaacugcuccaucgccggcuggauccuggggaacccggagugcgagagccuguucuccaagaaguccuggucguacaucgccgagacccccaacagcgagaacgggaccugcuaccccggcuacuucgccgacuacgaggagcuccgggagcagcuguccagcguguccucguucgagcgcuucgagaucuuccccaaggaguccagcuggccgaaccacacggucaccaagggcgugaccgccgccugcucccacaagggccggagcuccuucuaccgcaaccugcucuggcugaccgagaagaacgggcuguaccccaaccucucgaaguccuacgugaacaacaaggagaaggagguccuggugcuguggggcgugcaccaccccagcaacaucggggaccagcgggcgaucuaccacacggagaacgccuacgucagcgugguguccucgcacuacaaccgccgguucacccccgagaucgccaagcgcccgaagguccggggccaggagggccgcaucaacuacuacuggacccuccuggagcccggggacaccaucaucuucgaggccaacggcaaccugaucgcccccugguacgcguucgcccucucccggggguucggcagcggcaucaucacguccaacgccagcauggacgagugcgacgccaagugccagacgccccagggggccaucaacuccucgcugccguuccagaacgugcaccccgugaccaucggcgagugccccaaguacguccgcuccaccaagcugcggauggugaccgggcuccgcaacauccccagcauccagucccggggccuguucggggcgaucgccggcuucaucgagggcggguggaccggcaugaucgacgggugguacggcuaccaccaccagaacgagcaggggagcggcuacgccgccgaccagaaguccacccagaacgccaucaacggcaucaccaacaaggugaacucggucaucgagaagaugaacacgcaguucaccgcgguggggaaggaguucaacaagcuggagaagcgcauggagaaccucaacaagaagguggacgacggcuuccuggacaucuggaccuacaacgccgagcugcucguccugcuggagaacgagcggacccucgacuuccacgacuccaacgugaagaaccuguacgagaaggucaagaaccagcugaagaacaacgccaaggagaucgggaacggcugcuucgaguucuaccacaagugcaacaacgagugcauggagagcgugaagaacgggacguacgacuacccgaaguacuccgaggagagcaagcucaaccgcgagaagaucgacggcgugaagcuggaguccaugggcgucuaccagauccuggccaucuacucgaccguggccagcucccucgugcugcuggucagccucggggcgaucuccuucuggaugugcagcaacggcucccugcagugccggaucugcaucuga

SEQ ID NO: 2771 - RNA, 1689 nt, Artificial Sequence
  derived and/or modified CDS sequence (AUadapt) from InfluenzaA__ACN32272__HA
auggccaucaucuaccugauccuccuguucaccgccgugcgcggcgaccagaucugcaucggguaccacgcgaacaacucgaccgagaagaucgacacgauccuggagcggaacgucaccgugacccacgccaaggacauccucgagaagacccacaacggcaagcugugcaagcugaacgggaucccgccccucgagcugggcgacugcuccaucgccggguggcugcucggcaaccccgagugcgaccgccugcugcgggugcccgaguggucguacaucauggagaaggagaacccccgcuacucccucugcuacccgggcagcuucaacgacuacgaggagcugaagcaccuccuguccucggucaagcacuucgagaaggugaagauccugcccaaggaccgguggacgcagcacaccaccaccgggggcuccauggccugcgccgugagcgggaagcccuccuucuuccgcaacauggucuggcugacgaccaagggccccaacuacccgguggcgcaggggucguacaacaacaccuccggcgagcagaugcucaucaucuggggcgugcaccaccccaacgacgaggccgagcagcgggcccuguaccagaacgucgggaccuacgugagcgccuccacgucgacccuguacaagcgcuccauccccgagaucgcggcccggcccaaggugaacggccucgggagccgcauggaguucuccuggacccugcuggacaugugggacaccaucaacuucgagucgacgggcaaccucgucgccccggaguacggcuucaagaucuccaagcgggggucgagcggcaucaugaagaccgaggggacccuggagaacugcgagaccaagugccagacgccccugggcgccaucaacaccacccuccccuuccacaacgugcacccccugaccaucggggagugcccgaaguacgugaaguccgagaagcugguccucgccacgggccugcgcaacgugccccagaucgagucgcggggccuguucggggcgaucgccggcuucaucgagggcggguggcaggggaugguggacggcugguacggcuaccaccacuccaacgaccaggggagcggcuacgccgccgacaaggaguccacccagaaggccuucgacgggaucaccaacaaggucaacucggugaucgagaagaugaacacccaguucgaggcggugggcaaggaguucuccaaccucgagaagcgccuggagaaccugaacaagaagauggaggacggguuccucgacgucuggacguacaacgccgagcugcuggugcucauggagaacgagcggacccuggacuuccacgacagcaacgugaagaaccuguacgacaagguccgcaugcagcuccgggacaacgugaaggagcugggcaacggcugcuucgaguucuaccacaagugcgacaacgagugcauggacuccgucaagaacgggaccuacgacuaccccaaguacgaggaggagucgaagcugaaccgcaacgagaucaagggcgugaagcucuccagcauggggguguaccagauccuggccaucuacgccaccgucgccggcucccugucgcucgcgaucaugauggccggcaucuccuucuggaugugcagcaacgggucccugcagugccggaucugcaucuga

SEQ ID NO: 2772 - RNA, 1701 nt, Artificial Sequence
  derived and/or modified CDS sequence (AUadapt) from InfluenzaA__ACN32283__HA
augaagaccaucaucgcccugucguacauccucugccugguguccgcccagaaguuccccggcaacgacaacucgaccgcgacgcugugccucgggcaccacgccgucccgaacggcaccaucgugaagaccaucaccaacgaccagaucgaggugacgaacgccaccgagcugguccaguccagcuccaccggggagaucugcgacucgccccaccagauccuggacggcgagaacugcacccucaucgacgcccugcugggggacccccagugcgacggcuuccagaacaagaagugggaccucuucguggagcgcuccaaggccuacagcaacugcuaccccuacgacgugccggacuacgcgucccugcggucgcuggucgccuccagcggcacgcucgaguucaacaacgaguccuucaacuggaccggggugacccagaacggcaccucguccgccugcauccgccggagcaacaacuccuucuucucgcgccugaacuggcugacgcaccucaaguucaaguaccccgcccugaacgugaccaugcccaacaacgaggaguucgacaagcuguacaucuggggcguccaccaccccgggaccgacaacgaccagaucuuccucuacgcgcaggccuccgggcggaucaccgugagcacgaagcgcucgcagcagaccgugaucccgaacaucggcucccggccccgcguccggaacauccccagccgcaucuccaucuacuggaccaucgugaagcccggcgacauccugcugaucaacucgaccgggaaccucaucgccccgcggggcuacuucaagauccgcuccggcaagagcuccaucaugcggucggacgcccccaucgggaagugcaacuccgagugcaucacgcccaacggcagcauccccaacgacaagccguuccagaacgugaaccgcaucaccuacggggccugcccccgguacgucaagcagaacacccugaagcuggcgaccggcaugcgcaacgugcccgagaagcagacgcgggggaucuucggcgccaucgccggguucaucgagaacggcugggagggcaugguggacgggugguacggcuuccgccaccagaacuccgaggggaucggccaggccgccgaccucaagucgacccaggcggccaucgaccagaucaacgggaagcugaaccggcugaucggcaagaccaacgagaaguuccaccagaucgagaaggaguucuccgaggucgagggccgcauccaggaccucgagaaguacguggaggacaccaagaucgaccuguggagcuacaacgccgagcugcucguggcccuggagaaccagcacacgaucgaccugaccgacuccgagaugaacaagcuguucgagaagaccaagaagcagcuccgggagaacgccgaggacauggggaacggcugcuucaagaucuaccacaagugcgacaacgcgugcaucgggucgauccgcaacggcaccuacgaccacgacgucuaccgcgacgaggcccugaacaaccgguuccagaucaaggggguggagcucaaguccggcuacaaggacuggauccuguggaucagcuucgccaucuccugcuuccugcucugcguggcccugcugggcuucaucaugugggccugccagaaggggaacauccgcugcaacaucugcaucuga

SEQ ID NO: 2773 - RNA, 1701 nt, Artificial Sequence
  derived and/or modified CDS sequence (AUadapt) from InfluenzaA__ACN32474__HA
augaagaccaucaucgcccugucguacauccucugccugguguccgcccagaagcugcccggcaacgacaacucgaccgcgacgcucugccuggggcaccacgccgucccgaacggcaccaucgugaagaccaucaccaacgaccagaucgaggugacgaacgccaccgagcugguccaguccagcuccaccggggagaucugcgacucgccccaccaggugcucgacggcgagaacugcacccugaucgacgcccugcucggggacccccagugcgacggcuuccagaacaagaagugggaccuguucguggagcgcuccaaggccuacagcaacugcuaccccuacgacgucccggacuacacgucccugcggucgcucguggcguccagcggcacccuggaguucaacaacgaguccuucaacuggaccggggugacccagaacggcacgucguccgccugcauccgccggucgaacaacuccuucuucagccgccugaacuggcucacccaccugaaguucaaguaccccgcccugaacaugaccaugcccaacaacgaggaguucgacaagcucuacaucuggggcguccaccaccccgggaccgacaacgaccagaucuuccuguacgcccaggcguccgggcggaucacggugucgaccaagcgcagccagcagaccgugaucccgaacaucggcucccggccccgcguccggaacauccccucgcgcaucuccaucuacuggaccaucgugaagcccggcgacauccugcucaucaacagcacggggaaccugaucgccccgcggggcuacuucaagauccgcuccggcaagucguccaucaugcggucggacgcccccaucgggaagugcaacuccgagugcaucacccccaacggcagcauccccaacgacaagccguuccagaacgugaaccgcaucaccuacggggccugcccccgguacgucaagcagaacacccugaagcucgccacgggcaugcgcaacgugcccgagaagcagacccgggggaucuucggcgcgaucgccggguucaucgagaacggcugggagggcaugguggacgggugguacggcuuccgccaccagaacuccgaggggaucggccaggccgccgaccucaagucgacccaggccgcgaucgaccagaucaacgggaagcugaaccggcugaucggcaagaccaacgagaaguuccaccagaucgagaaggaguucuccgaggucgagggccgcauccaggaccuggagaaguacguggaggacacgaagaucgaccuguggagcuacaacgccgagcuccugguggcccuggagaaccagcacaccaucgaccucaccgacuccgagaugaacaagcuguucgagaagaccaagaagcagcugcgggagaacgccgaggacauggggaacggcugcuucaagaucuaccacaagugcgacaacgccugcaucgggucgauccgcaacggcacguacgaccacgaggucuaccgcgacgaggcgcucaacaaccgguuccagaucaaggggguggagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 2774 - RNA, 1698 nt, Artificial Sequence; identical to SEQ ID NO: 2733
  derived and/or modified CDS sequence (AUadapt) from InfluenzaA__ACN32501__HA

SEQ ID NO: 2775 - RNA, 1701 nt, Artificial Sequence
  derived and/or modified CDS sequence (AUadapt) from InfluenzaA__ACN32534__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucucgcuccgcucccugguggcgagcuccggcacgcuggaguucaacaacgagucguucaacuggaccgggguggcccagaacggcaccuccagcgccugcaagcggcgcuccgacaagucguucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccucggggcgcgugaccgucagcaccaagcggucccagcagaccgugaucccgaacaucggcucgggccccugggugcgcggggucuccagccggaucuccaucuacuggacgaucgugaagcccggcgacauccuccugaucaacucgaccgggaaccugaucgcgccccgcggcuacuucaagauccgguccggcaagagcuccaucaugcgcucggacgccccgaucgggaagugcaacuccgagugcaucacccccaacggcagcauccccaacgggaagcccuuccagaacgugaaccggaucaccuacggcgccugcccgcgcuacgucaagcagaacacgcucaagcuggccaccgggaugcggaacgugcccgagaagcagacccgcggcaucuucggcgccaucgccggguucaucgagaacggcugggaggggaugauggacggcugguacggguuccggcaccagaacuccgagggcaccggccaggccgccgaccugaaguccacgcaggcggccaucaaccagaucaacgggaagcucaaccgccugaucgagaagaccaacgagaaguuccaccagaucgagaaggaguucuccgagguggagggccggauccaggaccuggagaaguacgucgaggacaccaagaucgaccucuggucguacaacgccgagcugcugguggcccucgagaaccagcacaccaucgaccugacggacuccgagaugaacaagcuguucgagcgcaccaagaagcagcuccgggagaacgccgaggacauggggaacggcugcuucaagaucuaccacaagugcgacaacgcgugcaucgggagcauccgcaacggcaccuacgaccacgacguguaccgcgacgaggcccugaacaaccgguuccagaucaagggcgucgagcugaaguccggguacaaggacuggauccucuggaucucguucgccaucagcugcuuccugcugugcaucgugcuccugggcuucaucaugugggccugccagaaggggaacauccgcugcaacaucugcaucuga

SEQ ID NO: 2776 - RNA, 1701 nt, Artificial Sequence
  derived and/or modified CDS sequence (AUadapt) from InfluenzaA__ACN32545__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccacugcgacggcuuccagaacaagaagugggaccuguucguggagcgcagcaaggccuacuccaacugcuaccccuacgacgugccggacuacgcgucgcugcggucccucaucgccagcuccggcacgcuggaguucaacaacgagucguucaacuggaccggggucacccagaacggcaccuccagcgccugcauccgccgguccaacaacucguucuucucccgccugaacuggcucacgcaccugaaguucaaguaccccgcccugaacgugaccaugcccaacaacgagaaguucgacaagcucuacaucuggggcgugcaccaccccgggaccgacaacgaccagaucuuccuguacgcgcaggccagcgggcggaucaccgucuccacgaagcgcucgcagcagaccgugaucccgaacaucggcagccggccccgcgugcggaacauccccucccgcaucucgaucuacuggaccaucgucaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacgcccaacggcuccauccccaacgacaagccguuccagaacgugaaccgcaucaccuacggggccugcccccgguacgugaagcagaacacccugaagcucgcgaccggcaugcgcaacguccccgagaagcagacgcgggggaucuucggcgccaucgccggguucaucgagaacggcugggagggcaugguggacgggugguacggcuuccgccaccagaacucggaggggaucggccaggccgccgaccugaaguccacccaggcggccaucgaccagaucaacgggaagcugaaccggcucaucggcaagaccaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacacgaucgaccucaccgacucggagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacguguaccgcgacgaggcccucaacaaccgguuccagaucaagggggucgagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 2777 - RNA, 1698 nt, Artificial Sequence
  derived and/or modified CDS sequence (AUadapt) from InfluenzaA__ACN32793__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccucguucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcgaguccuacgccaacaacaaggagaaggaggugcucguccuguggggcgugcaccacccgcccaacaucggggaccagcgggcccuguaccacacggagaacgccuacgugucggucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggucgaccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgccgcggaccagaaguccacccagaacgccaucaacggcaucaccaacaaggugaacagcgucaucgagaagaugaacacgcaguucaccgccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacgugaagaaccuguacgagaaggucaagucccagcugaagaacaacgccaaggagaucgggaacggcugcuucgaguucuaccacaagugcaacgacgagugcauggagagcgugaagaacgggacguacgacuaccccaaguacuccgaggagucgaagcucaaccgcgagaagaucgacggcgugaagcuggaguccaugggcgucuaccagauccuggcgaucuacagcaccguggccagcucccucgugcugcuggucagccucggggccaucuccuucuggaugugcagcaacggcucccugcagugccggaucugcaucuga

SEQ ID NO: 2778 - RNA, 1698 nt, Artificial Sequence; identical to SEQ ID NO: 2202
  derived and/or modified CDS sequence (AUadapt) from InfluenzaA__ACN32804__HA

SEQ ID NO: 2779 - RNA, 1698 nt, Artificial Sequence; identical to SEQ ID NO: 2190
  derived and/or modified CDS sequence (AUadapt) from InfluenzaA__ACN32815__HA

SEQ ID NO: 2780 - RNA, 1698 nt, Artificial Sequence; identical to SEQ ID NO: 2200
  derived and/or modified CDS sequence (AUadapt) from InfluenzaA__ACN32826__HA

SEQ ID NO: 2781 - RNA, 1701 nt, Artificial Sequence; identical to SEQ ID NO: 2679
  derived and/or modified CDS sequence (AUadapt) from InfluenzaA__ACN32848__HA

SEQ ID NO: 2782 - RNA, 1701 nt, Artificial Sequence
  derived and/or modified CDS sequence (AUadapt) from InfluenzaA__ACN32870__HA
augaagaccaucaucgcccugucguacauccucugccugguguucgcccagaaguuccccggcaacgacaacuccaccgcgacgcugugccucgggcaccacgccgucccgaacggcaccaucgugaagaccaucaccaacgaccagaucgaggugacgaacgccaccgagcugguccagagcuccucgaccggggagaucugcgacagcccccaccagauccuggacggcgagaacugcacccucaucgacgcccugcugggggacccccagugcgacggcuuccagaacaagaacugggaccucuucguggagcgcucgaaggccuacuccaacugcuaccccuacgacgugccggacuacgcgagccugcggucccuggucgccucguccggcacgcucgaguucaacaacgagagcuucaacuggaccggggugacccagaacggcaccuccucggccugcauccgccgguccaacaacagcuucuucucccgccugaacuggcugacgcacucgaaguucaaguaccccgcccucaacgugaccaugcccaacaacgagaacuucgacaagcuguacaucuggggcguccaccaccccgggaccgacaacgaccagaucuuccuguacgcgcaggccuccgggcggaucaccgugagcacgaagcgcucgcagcagaccgugaucccgaacaucggcucccggccccgcguccggaacauccccagccgcaucuccaucuacuggaccaucgugaagcccggcgacauccuccugaucaacucgaccgggaaccugaucgccccgcggggcuacuucaagauccgcuccgggaaguccuccaucaugcggagcgacgcccccaucggcaagugcaacuccgagugcaucacgcccaacggcucgauccccaacgacaagccguuccagaacgugaaccgcaucaccuacggggccugcccccgguacgucaagcagaacacccucaagcuggcgaccggcaugcgcaacgugcccgagaagcagacgcgggggaucuucggcgccaucgccggguucaucgagaacggcugggagggcaugguggacgggugguacggcuuccgccaccagaacuccgaggggaucggccaggccgccgaccucaagagcacccaggcggccaucgaccagaucaacgggaagcugaaccggcugaucggcaagaccaacgagaaguuccaccagaucgagaaggaguucuccgaggucgagggccgcauccaggaccuggagaaguacguggaggacaccaagaucgaccucuggucguacaacgccgagcugcugguggcccucgagaaccagcacacgaucgaccugaccgacuccgagaugaacaagcuguucgagaagaccaagaagcagcuccgggagaacgccgaggacauggggaacggcugcuucaagaucuaccacaagugcgacaacgcgugcaucgggagcauccgcaacggcaccuacgaccacgacgucuaccgcgacgaggcccugaacaaccgguuccagaucaaggggguggagcugaaguccggcuacaaggacuggauccucuggaucagcuucgccaucuccugcuuccugcugugcaucgcccuccugggcuucaucaugugggccugccagaaggggaacauccgcugcaacaucugcaucuga

SEQ ID NO: 2783 - RNA, 1701 nt, Artificial Sequence; identical to SEQ ID NO: 2782
  derived and/or modified CDS sequence (AUadapt) from InfluenzaA__ACN32892__HA

SEQ ID NO: 2784 - RNA, 1701 nt, Artificial Sequence; identical to SEQ ID NO: 2679
  derived and/or modified CDS sequence (AUadapt) from InfluenzaA__ACN32903__HA

SEQ ID NO: 2785 - RNA, 1701 nt, Artificial Sequence
  derived and/or modified CDS sequence (AUadapt) from InfluenzaA__ACN32914__HA
augaagaccaucaucgcccugucguacauccucugccuggccuucgcgcagaagcugcccggcaacgacaacuccaccgccacgcucugccuggggcaccacgccgugccgaacggcaccaucgucaagaccaucaccaacgaccagaucgaggugacgaacgccaccgagcuggugcagucguccagcaccggggagaucugcgacucgccccaccagauccucgacggcgagaacugcacccugaucgacgcccugcucggggacccccagugcgacggcuuccagaacaagaagugggaccuguucgucgagcgcucgaaggcguacuccaacugcuaccccuacgacgugccggacuacgccagccugcggucccucguggccucguccggcacgcuggaguucaacaacgagagcuucaacuggaccggggucacccagaacggcaccuccucggccugcauccgccgguccaacaacucguucuucucccgccugaacuggcucacgcaccugaaguucaaguaccccgcgcugaacgugaccaugcccaacaacgagcaguucgacaagcucuacaucuggggcgugcaccaccccgggaccgacaacgaccagaucuuccuguacgcccaggccagcgggcggaucaccgucuccacgaagcgcucgcagcagaccgugaucccgaacaucggcucgcggccccgcgugcggaacauccccucccgcaucagcaucuacuggaccaucgucaagcccggcgacauccugcucaucaacuccaccgggaaccugaucgccccgcggggcuacuucaagauccgcucggggaaguccagcaucaugcgguccgacgcccccaucggcaagugcaacucggagugcaucacgcccaacggcuccauccccaacgacaagccguuccagaacgugaaccgcaucaccuacggggcgugcccccgguacgugaagcagaacacccugaagcucgccaccggcaugcgcaacguccccgagaagcagacgcgggggaucuucggcgccaucgccggguucaucgagaacggcugggagggcaugguggacgggugguacggcuuccgccaccagaacucggaggggcggggccaggccgcggaccugaaguccacccaggccgccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacacgaucgaccucaccgacucggagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacguguaccgggacgaggcccucaacaaccgcuuccagaucaagggggucgagcugaaguccggcuacaaggacuggauccuguggaucuccuucgccaucagcugcuuccuccugugcguggcccugcucggcuucaucaugugggcgugccagaaggggaacauccggugcaacaucugcaucuga

SEQ ID NO: 2786 - RNA, 1701 nt, Artificial Sequence; identical to SEQ ID NO: 2679
  derived and/or modified CDS sequence (AUadapt) from InfluenzaA__ACN32925__HA

SEQ ID NO: 2787 - RNA, 1701 nt, Artificial Sequence
  derived and/or modified CDS sequence (AUadapt) from InfluenzaA__ACN32936__HA
augaagaccaucaucgcccugucguacauccucugccugguguucgcccagaaguuccccggcaacgacaacuccaccgcgacgcugugccucgggcaccacgccgucccgaacggcaccaucgugaagaccaucaccaacgaccagaucgaggugacgaacgccaccgagcugguccagagcuccucgaccggggagaucugcgacagcccccaccagauccuggacggcgagaacugcacccucaucgacgcccugcugggggacccccagugcgacggcuuccagaacaagaacugggaccucuucguggagcgcucgaaggccuacuccaacugcuaccccuacgacgugccggacuacgcgagccugcggucccuggucgccucguccggcacgcucgaguucaacaacgagagcuucaacuggaccggggugacccagaacggcaccuccucggccugcauccgccgguccaacaacagcuucuucucccgccugaacuggcugacgcacucgaaguucaaguaccccgcccucaacgugaccaugcccaacaacgagaacuucgacaagcuguacaucuggggcguccaccaccccgggaccgacaacgaccagaucuuccuguacgcgcaggccuccgggcggaucaccgugagcacgaagcgcucgcagcagaccgugaucccgaacaucggcucccggccccgcaucaagaacauccccagccggaucuccaucuacuggaccaucgucaagcccggcgacauccuccugaucaacucgaccgggaaccugaucgccccgcgcggcuacuucaagauccgguccgggaaguccuccaucaugcgcagcgacgcccccaucggcaagugcaacuccgagugcaucacgcccaacggcucgauccccaacgacaagccguuccagaacgugaaccggaucaccuacggggccugcccccgcuacgugaagcagaacacccucaagcuggcgaccggcaugcggaacguccccgagaagcagacgcgcgggaucuucggcgccaucgccggguucaucgagaacggcugggagggcaugguggacgggugguacggcuuccggcaccagaacuccgaggggaucggccaggccgccgaccucaagagcacccaggcggccaucgaccagaucaacgggaagcugaaccgccugaucggcaagaccaacgagaaguuccaccagaucgagaaggaguucuccgagguggagggccggauccaggaccuggagaaguacgucgaggacaccaagaucgaccucuggucguacaacgccgagcugcugguggcccucgagaaccagcacacgaucgaccugaccgacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacgacguguaccgcgacgaggcccugaacaaccgcuuccagaucaagggggucgagcugaaguccggcuacaaggacuggauccucuggaucagcuucgccaucuccugcuuccugcugugcaucgcccuccugggcuucaucaugugggccugccagaaggggaacauccggugcaacaucugcaucuga

SEQ ID NO: 2788 - RNA, 1701 nt, Artificial Sequence; identical to SEQ ID NO: 2679
  derived and/or modified CDS sequence (AUadapt) from InfluenzaA__ACN32947__HA

SEQ ID NO: 2789 - RNA, 1701 nt, Artificial Sequence
  derived and/or modified CDS sequence (AUadapt) from InfluenzaA__ACN32958__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcaacaaggccuacagcaacugcuaccccuacgacgugccggacuacgcgucccugcggucgcucgucgccuccucgggcacgcuggaguucaacaacgaguccuucaacuggaccggggugacccagaacggcaccagcuccgccugcauccgccggucgaacaacuccuucuucagccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccuccgggcggaucaccgugucgacgaagcgcucccagcagaccgugaucccgaacaucggcucgcggccccgcguccggaacauccccagccgcaucuccaucuacuggaccaucgugaagcccggcgacauccugcucaucaacucgaccgggaaccugaucgccccgcggggcuacuucaagauccgcuccgggaaguccuccaucaugcggagcgacgcccccaucggcaagugcaacuccgagugcaucacgcccaacggcucgauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggcggggccaggccgccgaccucaagucgacccaggcggccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgcgugcaucgggucgauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 2790 - RNA, 1701 nt, Artificial Sequence
  derived and/or modified CDS sequence (AUadapt) from InfluenzaA__ACN32969__HA
augaagaccaucaucgcccugucguacauccucugccugguguccgcccagaagcugcccggcaacgacaacucgaccgcgacgcucugccuggggcaccacgccgucccgaacggcaccaucgugaagaccaucaccaacgaccagaucgaggugacgaacgccaccgagcugguccaguccagcuccaccggggagaucugcgacucgccccaccaggugcucgacggcgagaacugcacccugaucgacgcccugcucggggacccccagugcgacggcuuccagaacaagaagugggaccuguucguggagcgcuccaaggccuacagcaacugcuaccccuacgacgucccggacuacgcgucccugcggucgcucguggccuccucgggcacgcuggaguucaacaacgaguccuucaacuggaccggggugacccagaacggcaccagcuccgccugcauccgccggucgaacaacuccuucuucagccgccugaacuggcucacgcacuccaaguucaaguaccccgcccugaacgucaccaugcccaacaacgaggaguucgacaagcuguacaucuggggcgugcaccaccccgggaccgacaacgaccagaucuuccucuacgcgcaggccucggggcggaucaccgugucgacgaagcgcucccagcagaccgucaucccgaacaucggcagccggccccgcgugcggaacauccccucccgcaucucgaucuacuggaccaucgugaagcccggcgacauccugcugaucaacuccaccgggaaccucaucgccccgcggggcuacuucaagcugcgcagcgggaaguccucgaucaugcgguccgacgcccccaucggcaagugcaacucggagugcaucacgcccaacggcuccauccccaacgacaagccguuccagaacgucaaccgcaucaccuacggggccugcccccgguacgugaagcagaacacccugaagcucgcgaccggcaugcgcaacgugcccgagaagcagacgcgggggaucuucggcgccaucgccggguucaucgagaacggcugggagggcauggucgacgggugguacggcuuccgccaccagaacagcgaggggaucggccaggccgccgaccugaaguccacccaggcggccaucgaccagaucaacgggaagcugaaccggcucaucggcaagaccaacgagaaguuccaccagaucgagaaggaguucucggagguggagggccgcauccaggaccuggagaaguacguggaggacaccaagaucgaccugugguccuacaacgccgagcuccuggucgcccuggagaaccagcacacgaucgaccucaccgacagcgagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgagguguaccgcgacgaggcccucaacaaccgguuccagaucaaggggguggagcucaagucgggcuacaaggacuggauccuguggaucuccuucgccaucagcugcuuccugcugugcgucgcccugcucggcuucaucaugugggccugccagaaggggaacauccgcugcaacaucugcaucuga

SEQ ID NO: 2791 - RNA, 1701 nt, Artificial Sequence
  derived and/or modified CDS sequence (AUadapt) from InfluenzaA__ACN32980__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaagaacagcuucuucucccgccugaacuggcucacgcaccugaaguucaaguaccccgcccugaacgugaccaugcccaacgacgagaaguucgacaagcucuacaucuggggcguccaccaccccgggaccgacaacgaccagaucuuccuguacgcgcaggccucggggcggaucaccguguccacgaagcgcagccagcagaccgugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggaucggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgggagaacgccgaggacauggggaacggcugcuucaagaucuaccacaagugcgacaacgcgugcgucggguccauccgcaacggcaccuacgaccacgacguguaccgcgacgaggcccucaacaaccgguuccagaucaaggggguggagcugaaguccggcuacaaggacuggauccuguggaucuccuucgccaucagcugcuuccuccugugcgucgcccugcucggcuucaucaugugggccugccagaaggggaacauccgcugcaacaucugcaucuga

SEQ ID NO: 2792 - RNA, 1701 nt, Artificial Sequence; identical to SEQ ID NO: 2679
  derived and/or modified CDS sequence (AUadapt) from InfluenzaA__ACN32991__HA

SEQ ID NO: 2793 - RNA, 1701 nt, Artificial Sequence; identical to SEQ ID NO: 2679
  derived and/or modified CDS sequence (AUadapt) from InfluenzaA__ACN33002__HA

SEQ ID NO: 2794 - RNA, 1701 nt, Artificial Sequence; identical to SEQ ID NO: 2679
  derived and/or modified CDS sequence (AUadapt) from InfluenzaA__ACN33013__HA

SEQ ID NO: 2795 - RNA, 1701 nt, Artificial Sequence
  derived and/or modified CDS sequence (AUadapt) from InfluenzaA__ACN33035__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcaccugaaguucaaguaccccgcccugaacgugaccaugcccaacaacgagcaguucgacaagcucuacgucuggggcgugcaccaccccgggaccgacaacgaccagaucuuccuguacgcgcaggccucggggcggaucaccguguccacgaagcgcagccagcagaccgucaucccgaacaucggcucgcggccccgcgugcggaacauccccucccgcaucagcaucuacuggaccaucgugaagcccggcgacauccugcucaucaacuccaccgggaaccugaucgccccgcggggcuacuucaagauccgcucggggaaguccucgaucaugcgguccgacgcccccaucggcaagugcaacagcgagugcaucacgcccaacggcuccauccccaacgacaagccguuccagaacgucaaccgcaucaccuacggggccugcccccgguacgugaagcagaacacccugaagcucgcgaccggcaugcgcaacgugcccgagaagcagacgcgggggaucuucggcgccaucgccggguucaucgagaacggcugggagggcauggucgacgggugguacggcuuccgccaccagaacucggaggggcggggccaggccgccgaccugaaguccacccaggcggccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcccuggagaaccagcacacgaucgaccucaccgacucggagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcccugcucggcuucaucaugugggccugccagaaggggaacauccggugcaacaucugcaucuga

SEQ ID NO: 2796 - RNA, 1701 nt, Artificial Sequence; identical to SEQ ID NO: 2679
  derived and/or modified CDS sequence (AUadapt) from InfluenzaA__ACN33046__HA

SEQ ID NO: 2797 - RNA, 1701 nt, Artificial Sequence; identical to SEQ ID NO: 2679
  derived and/or modified CDS sequence (AUadapt) from InfluenzaA__ACN33057__HA

SEQ ID NO: 2798 - RNA, 1701 nt, Artificial Sequence; identical to SEQ ID NO: 2679
  derived and/or modified CDS sequence (AUadapt) from InfluenzaA__ACN33068__HA

SEQ ID NO: 2799 - RNA, 1701 nt, Artificial Sequence; identical to SEQ ID NO: 2782
  derived and/or modified CDS sequence (AUadapt) from InfluenzaA__ACN33079__HA

SEQ ID NO: 2800 - RNA, 1698 nt, Artificial Sequence
  derived and/or modified CDS sequence (AUadapt) from InfluenzaA__ACN33090__HA
augaaggugaagcugcucauccugcugugcaccuucaccgccacguacgccgacaccaucugcaucggcuaccacgcgaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccucguucgagcgguucgagaucuucccgaaggaguccagcuggcccaaccacaccgugaccggggucuccgccagcugcucccacaacggcaagagcuccuucuaccgcaaccugcuguggcucaccgggaagaacggccuguaccccaaccugagcaaguccuacgccaacaacaaggagaaggaggugcucgugcuguggggcguccaccaccccucgaacaucggggaccagcgggcccuguaccacacggagaacgccuacgugagcguggucuccagccacuacucccgccgguucaccccggagaucgccaagcgccccaaggugcgggaccaggagggccgcaucaacuacuacuggacccuccuggagcccggggacaccaucaucuucgaggcgaacggcaaccugaucgcgccccgguucgccuucgcccucagccgcggguucggcuccggcaucaucacgagcaacgccccgauggacgagugcgacgccaagugccagacgccccagggggccaucaacuccucgcugcccuuccagaacgugcaccccgucaccaucggcgagugcccgaaguacgugcgguccaccaagcugcgcauggugaccgggcuccggaacauccccagcauccagucccgcggccuguucggggccaucgccggcuucaucgagggcggguggaccggcauggucgacgggugguacggcuaccaccaccagaacgagcaggggagcggcuacgccgcggaccagaaguccacccagaacgccaucaacggcaucaccaacaaggugaacagcgugaucgagaagaugaacacgcaguucaccgccgucgggaaggaguucaacaagcuggagcggcgcauggagaaccucaacaagaagguggacgacggcuuccuggacaucuggaccuacaacgccgagcugcucguccugcuggagaacgagcggacccucgacuuccacgacuccaacgugaagaaccuguacgagaaggucaagagccagcugaagaacaacgccaaggagaucgggaacggcugcuucgaguucuaccacaagugcaacgacgagugcauggaguccgugaagaacgggacguacgacuaccccaaguacucggaggaguccaagcucaaccgcgagaagaucgacggcgugaagcuggagagcaugggcguguaccagauccuggcgaucuacagcaccgucgccuccagccucgugcugcuggugucccucggggccaucagcuucuggaugugcuccaacggcagccugcagugccggaucugcaucuga

SEQ ID NO: 2801 - RNA, 1698 nt, Artificial Sequence; identical to SEQ ID NO: 2159
  derived and/or modified CDS sequence (AUadapt) from InfluenzaA__ACN33101__HA

SEQ ID NO: 2802 - RNA, 1701 nt, Artificial Sequence; identical to SEQ ID NO: 2782
  derived and/or modified CDS sequence (AUadapt) from InfluenzaA__ACN33112__HA

SEQ ID NO: 2803 - RNA, 1698 nt, Artificial Sequence; identical to SEQ ID NO: 2733
  derived and/or modified CDS sequence (AUadapt) from InfluenzaA__ACN33123__HA

SEQ ID NO: 2804 - RNA, 1698 nt, Artificial Sequence; identical to SEQ ID NO: 2733
  derived and/or modified CDS sequence (AUadapt) from InfluenzaA__ACN33145__HA

SEQ ID NO: 2805 - RNA, 1701 nt, Artificial Sequence; identical to SEQ ID NO: 2679
  derived and/or modified CDS sequence (AUadapt) from InfluenzaA__ACN33156__HA

SEQ ID NO: 2806 - RNA, 1701 nt, Artificial Sequence
  derived and/or modified CDS sequence (AUadapt) from InfluenzaA__ACN33178__HA
augaagaccaucaucgcccugucguacauccucugccugguguucgcccagaaguuccccggcaacgacaacuccaccgcgacgcugugccucgggcaccacgccgucccgaacggcaccaucgugaagaccaucaccaacgaccagaucgaggugacgaacgccaccgagcugguccagagcuccucgaccggggagaucugcgacagcccccaccagauccuggacggcgagaacugcacccucaucgacgcccugcugggggacccccagugcgacggcuuccagaacaagaacugggaccucuucguggagcgcucgaaggccuacuccaacugcuaccccuacgacgugccggacuacgcgagccugcggucccuggucgccucguccggcacgcucgaguucaacaacgagagcuucaacuggaccggggugacccagaacggcaccuccucggccugcauccgccgguccaacaacagcuucuucucccgccugaacuggcugacgcacucgaaguucaaguaccccgcccucaacgugaccaugcccaacaacgagaacuucgacaagcuguacaucuggggcguccaccaccccgggaccgacaacgaccagaucuuccuguacgcgcaggccuccgggcggaucaccgugagcacgaagcgcucgcagcagaccgugaucccgaacaucggcucccggccccgcguccggaacauccccagccgcaucuccaucuacuggaccaucgugaagcccggcgacauccuccugaucaacucgaccgggaaccugaucgccccgcggggcuacuucaagauccgcuccgggaaguccuccaucaugcggagcgacgcccccaucggcaagugcaacuccgagugcaucacgcccaacggcucgauccccaacgacaagccguuccagaacgugaaccgcaucaccuacggggccugcccccgguacgucaagcagaacacccucaagcuggcgaccggcaugcgcaacgugcccgagaagcagacgcgggggaucuucggcgccaucgccggguucaucgagaacggcugggagggcaugguggacgggugguacggcuuccgccaccagaacuccgaggggaucggccaggccgccgaccucaagagcacccaggcggccaucgaccagaucaacgggaagcugaaccggcugaucggcaagaccaacgagaaguuccaccagaucgagaaggaguucuccgaggucgagggccgcauccaggaccuggagaaguacguggaggacaccaagaucgaccucuggucguacaacgccgagcugcugguggcccucgagaaccagcacacgaucgaccugaccgacuccgagaugaacaagcuguucgagaagaccaagaagcagcuccgggagaacgccgaggacauggggaacggcugcuucaagaucuaccacaagugcgacaacgcgugcaucgggagcauccgcaacggcaccuacgaccacgacgucuaccgcgacgaggcccugaacaaccgguuccacaucaaggggguggagcugaaguccggcuacaaggacuggauccucuggaucagcuucgccaucuccugcuuccugcugugcaucgcccuccugggcuucaucaugugggccugccagaaggggaacauccgcugcaacaucugcaucuga

SEQ ID NO: 2807 - RNA, 1701 nt, Artificial Sequence; identical to SEQ ID NO: 2679
  derived and/or modified CDS sequence (AUadapt) from InfluenzaA__ACN33189__HA

SEQ ID NO: 2808 - RNA, 1701 nt, Artificial Sequence
  derived and/or modified CDS sequence (AUadapt) from InfluenzaA__ACN33200__HA
augaagaccaucaucgcccugucguacauccucugccugguguucgcccagaaguuccccggcaacgacaacuccaccgcgacgcugugccucgggcaccacgccgucccgaacggcaccaucgugaagaccaucaccaacgaccagaucgaggugacgaacgccaccgagcugguccagagcuccucgaccggggagaucugcgacagcccccaccagauccuggacggcgagaacugcacccucaucgacgcccugcugggggacccccagugcgacggcuuccagaacaagaacugggaccucuucguggagcgcucgaaggccuacuccaacugcuaccccuacgacgugccggacuacgcgagccugcggucccuggucgccucguccggcacgcucgaguucaacaacgagagcuucaacuggaccggggugacccagaacggcaccuccucggccugcauccgccgguccaacaacagcuucuucucccgccugaacuggcugacgcacucgaaguucaaguaccccgcccucaacgugaccaugcccaacaacgagaacuucgacaagcuguacaucuggggcguccaccaccccgggaccgacaacgaccagaucuuccuguacgcgcaggccuccgggcggaucaccgugagcacgaagcgcucgcagcagaccgugaucccgaacaucggcucccggccccgcguccggaacauccccagccgcaucuccaucuacuggaccaucguggagcccggcgacauccuccugaucaacucgaccgggaaccugaucgccccgcggggcuacuucaagauccgcuccgggaaguccuccaucaugcggagcgacgcccccaucggcaagugcaacuccgagugcaucacgcccaacggcucgauccccaacgacaagccguuccagaacgugaaccgcaucaccuacggggccugcccccgguacgucaagcagaacacccucaagcuggcgaccggcaugcgcaacgugcccgagaagcagacgcgggggaucuucggcgccaucgccggguucaucgagaacggcugggagggcaugguggacgggugguacggcuuccgccaccagaacuccgaggggaucggccaggccgccgaccucaagagcacccaggcggccaucgaccagaucaacgggaagcugaaccggcugaucggcaagaccaacgagaaguuccaccagaucgagaaggaguucuccgaggucgagggccgcauccaggaccuggagaaguacguggaggacaccaagaucgaccucuggucguacaacgccgagcugcugguggcccucgagaaccagcacacgaucgaccugaccgacuccgagaugaacaagcuguucgagaagaccaagaagcagcuccgggagaacgccgaggacauggggaacggcugcuucaagaucuaccacaagugcgacaacgcgugcaucgggagcauccgcaacggcaccuacgaccacgacgucuaccgcgacgaggcccugaacaaccgguuccagaucaaggggguggagcugaaguccggcuacaaggacuggauccucuggaucagcuucgccaucuccugcuuccugcugugcaucgcccuccugggcuucaucaugugggccugccagaaggggaacauccgcugcaacaucugcaucuga

SEQ ID NO: 2809 - RNA, 1701 nt, Artificial Sequence
  derived and/or modified CDS sequence (AUadapt) from InfluenzaA__ACN33211__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcuccaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccucggggcggaucaccguguccacgaagcgcagccagcagaccgugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccagcaucaugcgguccgacgcccccaucggcaagugcaacucggagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagaccaacgagaaguuccaccagaucgagaaggaguucucggaggucgagggccggauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucucgaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 2810 - RNA, 1698 nt, Artificial Sequence; identical to SEQ ID NO: 2201
  derived and/or modified CDS sequence (AUadapt) from InfluenzaA__ACN42981__HA

SEQ ID NO: 2811 - RNA, 1698 nt, Artificial Sequence; identical to SEQ ID NO: 2435
  derived and/or modified CDS sequence (AUadapt) from InfluenzaA__ACN42992__HA

SEQ ID NO: 2812 - RNA, 1701 nt, Artificial Sequence; identical to SEQ ID NO: 2679
  derived and/or modified CDS sequence (AUadapt) from InfluenzaA__ACN43003__HA

SEQ ID NO: 2813 - RNA, 1701 nt, Artificial Sequence
  derived and/or modified CDS sequence (AUadapt) from InfluenzaA__ACN43014__HA
augaagaccaucaucgcccugucguacauccucugccugguguucgcccagaaguuccccggcaacgacaacuccaccgcgacgcugugccucgggcaccacgccgucccgaacggcaccaucgugaagaccaucaccaacgaccagaucgaggugacgaacgccaccgagcugguccagagcuccucgaccggggagaucugcgacagcccccaccagauccuggacggcgagaacugcacccucaucgacgcccugcugggggacccccagugcgacggcuuccagaacaagaacugggaccucuucguggagcgcucgaaggccuacuccaacugcuaccccuacgacgugccggacuacgcgagccugcggucccuggucgccagcuccggcacgcucgaguucaacaacgagucguucaacuggaucggggugacccagaacggcaccuccagcgccugcauccgccgguccaacaacucguucuucucccgccugaacuggcugacccacagcaaguucaaguaccccgcccucaacgugacgaugcccaacaacgagaacuucgacaagcuguacaucuggggcguccaccaccccgggaccgacaacgaccagaucuuccuguacgcgcaggccuccgggcggaucaccgugagcaccaagcgcucgcagcagacggugaucccgaacaucggcucccggccccgcguccggaacauccccagccgcaucuccaucuacuggaccaucgugaagcccggcgacauccuccugaucaacucgaccgggaaccugaucgccccgcggggcuacuucaagauccgcuccgggaaguccuccaucaugcggagcgacgcccccaucggcaacugcaacuccgagugcaucacccccaacggcagcauccccaacgacaagccguuccagaacgugaaccgcaucacguacggguccugcccccgguacgucaagcagaacacccucaagcuggccaccggcaugcgcaacgugcccgagaagcagacccgggggaucuucggcgcgaucgccggguucaucgagaacggcugggagggcaugguggacgggugguacggcuuccgccaccagaacucggaggggaucggccaggccgccgaccugaaguccacgcaggccgcgaucgaccagaucaacgggaagcucaaccggcugaucggcaagaccaacgagaaguuccaccagaucgagaaggaguucagcgaggucgagggccgcauccaggaccuggagaaguacguggaggacaccaagaucgaccucugguccuacaacgccgagcugcugguggcccucgagaaccagcacaccaucgaccugacggacucggagaugaacaagcuguucgagaagaccaagaagcagcuccgggagaacgccgaggacauggggaacggcugcuucaagaucuaccacaagugcgacaacgccugcaucggguccauccgcaacggcaccuacgaccacgacgucuaccgcgacgaggcgcugaacaaccgguuccagaucaaggggguggagcucaagagcggcuacaaggacuggauccuguggaucuccuucgccaucagcugcuuccugcugugcaucgcccuccugggcuucaucaugugggccugccagaaggggaacauccgcugcaacaucugcaucuga

SEQ ID NO: 2814 - RNA, 1701 nt, Artificial Sequence; identical to SEQ ID NO: 2679
  derived and/or modified CDS sequence (AUadapt) from InfluenzaA__ACN43025__HA

SEQ ID NO: 2815 - RNA, 1701 nt, Artificial Sequence; identical to SEQ ID NO: 2679
  derived and/or modified CDS sequence (AUadapt) from InfluenzaA__ACN43036__HA

SEQ ID NO: 2816 - RNA, 1701 nt, Artificial Sequence; identical to SEQ ID NO: 2679
  derived and/or modified CDS sequence (AUadapt) from InfluenzaA__ACN43047__HA

SEQ ID NO: 2817 - RNA, 1701 nt, Artificial Sequence
  derived and/or modified CDS sequence (AUadapt) from InfluenzaA__ACN43058__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcggcucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucgucgccagcuccgggacgcuggaguucaacaacgagucguucaacuggaccggcgugacccagaacgggaccuccucggccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccucgggccggaucaccguguccacgaagcgcagccagcagaccgugaucccgaacaucggcucgcggccccgcguccggaacauccccucccgcaucagcaucuacuggaccaucgugaagcccggggacauccugcucaucaacuccaccggcaaccugaucgccccgcggggguacuucaagauccgcucgggcaaguccucgaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacucggagggccgggggcaggccgccgaccugaaguccacccaggcggccaucgaccagaucaacggcaagcugaaccgccucaucggcaagaccaacgagaaguuccaccagaucgagaaggaguucagcgaggucgaggggcggauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 2818 - RNA, 1701 nt, Artificial Sequence; identical to SEQ ID NO: 2679
  derived and/or modified CDS sequence (AUadapt) from InfluenzaA__ACN43069__HA

SEQ ID NO: 2819 - RNA, 1701 nt, Artificial Sequence; identical to SEQ ID NO: 2782
  derived and/or modified CDS sequence (AUadapt) from InfluenzaA__ACN43080__HA

SEQ ID NO: 2820 - RNA, 1701 nt, Artificial Sequence
  derived and/or modified CDS sequence (AUadapt) from InfluenzaA__ACN72617__HA
auggaggccaagcuguucguccucuucugcgccuucaccgcgcugaaggccgacaccaucugcgugggcuaccacgccaacaacucgacggacaccguggacaccauccuggagaagaacgugaccgucacgcacuccgugaaccuccuggagaacagccacaacgggaagcugugcucccucaacggcaaggcgccccugcagcuggggaacugcaacguggccggcuggauccucgggaacccggagugcgaccugcugcucaccgccaacucgugguccuacaucaucgagaccagcgacuccaagaacggcgccugcuaccccggcgaguucgccgacuacgaggagcugcgcgagcagcugucgaccgucuccagcuucgagcgguucgagaucuuccccaaggccacguccuggcccaaccacgagaccaccaaggggaccacgguggcgugcucgcacuccggcgccaacagcuucuaccgcaaccuccuguggaucgugaagaaggggaacuccuacccgaagcugucgaaguccuacaccaacaacaagggcaaggagguccucgugaucuggggcgugcaccacccgcccaccgacagcgaccagcagacccuguaccagaacaagcacacguacgucuccguggggucgagcaaguacuaccagcgguucacccccgagaucgugacccgccccaagguccgggagcaggccggccgcaugaacuacuacuggacccugcucgaccagggggacacgaucaccuucgaggccaccggcaaccugaucgcccccuggcacgcguucgcccugaacaagggguccaacagcggcaucaugauguccgacgcccacgugcacaacugcaccacgaagugccagacgccccacggcgcccucaaggggaaccugcccuuccagaacgugcacccgaucaccaucggcgagugccccaaguacgucaagucgacccagcugcggauggccaccgggcuccgcaacauccccuccauccagagccggggccuguucggggcgaucgccggcuucaucgagggcggguggaccggcaugaucgacgggugguacggcuaccaccaccagaacgagcagggguccggcuacgccgccgaccgcaagucgacccagaucgccaucgacggcaucuccaacaaggugaacagcgugaucgagaagaugaacauccaguucaccuccgucgggaaggaguucaacaaccuggagaagcggaucgagaaccucaacaagaagguggacgacggcuuccuggacguguggacguacaacgcggagcugcucauccugcuggagaacgagcgcacccucgacuuccacgacuucaacgucaagaaccuguacgagaaggucaagucgcagcugcggaacaacgccaaggagaucgggaacggcugcuucgaguucuaccacaagugcgacaacgagugcauggaguccgugaagaacgggaccuacaacuacccccgcuacagcgaggaguccaagcucaaccgggaggagaucgacggcgugaagcuggagucggugggcguccaccagauccuggccaucuacuccaccguggccagcucccucgugcugcuggucucgcucggggccaucagcuucuggaugugcuccaacggcagccugcagugccgcaucugcaucuga

SEQ ID NO: 2821 - RNA, 1701 nt, Artificial Sequence
  derived and/or modified CDS sequence (AUadapt) from InfluenzaA__ACN72632__HA
augaagaccgugaucgcccugucguacgucuucugccucguguucggccaggaccugcccgggaagggcaacaacaccgccacgcugugccucgggcaccacgcggugccgaacggcacccuggucaagaccaucaccgacgaccagaucgaggugacgaacgccaccgagcuggugcagaacuucuccaucgggaagaucugcaagaacccccaccgcauccucgacggcgccaacugcacccugaucgacagccugcucggcgacccccacugcgacggguuccagaacgagaagugggaccuguucaucgagcgguccaaggccuucucgaacugcuaccccuacgacgucccggaguacaccucccugcgcagccucaucgccuccagcggcacgcuggaguucaccaacgaggacuucaacuggaccggggugacccagaacggcggguccucggcgugcaagcggggccccaacaacuccuucuucagccgccugaacuggcucuacaaguccggcaacacguaccccaugcugaacgugaccaugcccaacucggacgacuucgacaagcuguacaucuggggcguccaccacccguccaccgaccgggagcagaccaaccucuacauccaggccagcgggaagaucaucguguccacgaagcgcagccagcagaccaucauccccaacaucgggucccggcccugggugcgcggccugucgagccggaucuccaucuacuggaccaucgucaagcccggcgacauccugaucaucaacucgaacgggaaccucaucgccccgcgcggcuacuucaagauccagaccgggaaguccagcgugaugcgguccgacgcccccaucggcacgugcaacuacgagugcaucacccccaacgggagcauccccaacgacaagccguuccagaacgugaaccgcaucaccuacggcgcgugcccccacuacaucaagcagaacacccugaagcuggccacgggcaugcggaacauccccgagcgccagacccgggggaucuucggcgccaucgccggguucaucgagaacggcugggaggggauggucaacggcugguacggcuuccgccaccagaacuccgaggggaucggccaggccgcggaccucaagucgacccaggccgccaucaaccagaucaacgggaagcugaaccgggugaucgagaagaccaacgagaaguuccaccagaucgagaaggaguucuccgagguggagggccgcauccaggaccuggagcgguacgucgaggacacgaagaucgaccucuggagcuacaacgccgagcugcugguggcccucgagaaccagcacaccaucgaccugaccgacuccgagaugaacaagcuguucgagaagacccgcaagcagcuccgggagaacgcggaggacauggggaacggcugcuucaagaucuaccacaagugcgacaacucgugcauggaguccauccgcaacggcacguacgaccacaacgaguaccgcgacgaggccgugaacaaccgguuccagaucaagagcgucgagcugaaguccggguacaaggacuggauccuguggaucagcuucgccaucuccugcuuccuccugugcgccguguggcugggcuucaucaucugggccugccagaaggggaacauccgcugcaacaucugcaucuga

SEQ ID NO: 2822 - RNA, 1701 nt, Artificial Sequence; identical to SEQ ID NO: 2679
  derived and/or modified CDS sequence (AUadapt) from InfluenzaA__ACN76478__HA

SEQ ID NO: 2823 - RNA, 1701 nt, Artificial Sequence
  derived and/or modified CDS sequence (AUadapt) from InfluenzaA__ACN76489__HA
augaagaccaucaucgcccugggcuacauccucugccuggugucggcccagaagcugcccgggaacgacaacuccaccgcgacgcucugccugggccaccacgccgucccgaacgggaccaucgugaagaccaucaccaacgaccagaucgaggugacgaacgccaccgagcugguccagucguccagcaccggcgagaucugcgacucgccccaccaggugcucgacggggagaacugcacccugaucgacgcccugcucggcgacccccagugcgacggcuuccagaacaagaagugggaccuguucguggagcgcucgaaggccuacuccaacugcuaccccuacgacgucccggacuacgcgagccugcggucccucguggccucguccgggacgcuggaguucaacaacgagagcuucaacuggaccggcgugacccagaacgggaccuccucggccugcauccgccgguccaacaacucguucuucucccgccugaacuggcucacgcaccugaaguucaaguaccccgcccugaacgucaccaugcccaacaacgaggaguucgacaagcucuacaucuggggcgugcaccaccccgggaccgacaacgaccagaucuuccuguacgcgcaggccagcggccggaucaccguguccacgaagcgcucgcagcagaccgucaucccgaacaucggcucgcggccccgcgugcggaacauccccucccgcaucagcaucuacuggaccaucgugaagcccggggacauccugcucaucaacuccaccggcaaccugaucgccccgcggggguacuucaagauccgcucgggcaaguccagcaucaugcgguccgacgcccccaucggcaagugcaacucggagugcaucacgcccaacggguccauccccaacgacaagccguuccagaacgucaaccgcaucaccuacggcgccugcccccgguacgugaagcagaacacccugaagcucgcgaccgggaugcgcaacgugcccgagaagcagacgcggggcaucuucggggccaucgccggcuucaucgagaacggcugggaggggauggucgacggcugguacggguuccgccaccagaacucggagggcaucgggcaggccgccgaccugaaguccacccaggcggccaucgaccagaucaacggcaagcugaaccggcucaucggcaagaccaacgagaaguuccaccagaucgagaaggaguucagcgagguggaggggcgcauccaggaccuggagaaguacguggaggacaccaagaucgaccugugguccuacaacgccgagcuccuggucgcccuggagaaccagcacacgaucgaccucaccgacucggagaugaacaagcuguucgagaagaccaagaagcagcugcgggagaacgccgaggacaugggcaacgggugcuucaagaucuaccacaagugcgacaacgcgugcaucggcuccauccgcaacgggaccuacgaccacgagguguaccgcgacgaggcccucaacaaccgguuccagaucaagggcguggagcugaaguccggcuacaaggacuggauccuguggaucuccuucgccaucagcugcuuccuccugugcgucgcccugcucggguucaucaugugggccugccagaagggcaacauccgcugcaacaucugcaucuga

SEQ ID NO: 2824 - RNA, 1701 nt, Artificial Sequence; identical to SEQ ID NO: 2679
  derived and/or modified CDS sequence (AUadapt) from InfluenzaA__ACN76500__HA

SEQ ID NO: 2825 - RNA, 1701 nt, Artificial Sequence; identical to SEQ ID NO: 2679
  derived and/or modified CDS sequence (AUadapt) from InfluenzaA__ACN76511__HA

SEQ ID NO: 2826 - RNA, 1701 nt, Artificial Sequence; identical to SEQ ID NO: 2679
  derived and/or modified CDS sequence (AUadapt) from InfluenzaA__ACN76522__HA

SEQ ID NO: 2827 - RNA, 1701 nt, Artificial Sequence; identical to SEQ ID NO: 2679
  derived and/or modified CDS sequence (AUadapt) from InfluenzaA__ACO36331__HA

SEQ ID NO: 2828 - RNA, 1701 nt, Artificial Sequence
  derived and/or modified CDS sequence (AUadapt) from InfluenzaA__ACO36342__HA
augaagaccaucaucgcccugucguacauccucugccugguguucgcccagaaguuccccggcaacgacaacuccaccgcgacgcugugccucgggcaccacgccgucccgaacggcaccaucgugaagaccaucaccaacgaccagaucgaggugacgaacgccaccgagcugguccagagcuccucgaccggggagaucugcgacagcccccaccagauccuggacggcgagaacugcacccucaucgacgcccugcugggggacccccagugcgacggcuuccagaacaagaacugggaccucuucguggagcgcucgaaggccuacuccaacugcuaccccuacgacgugccggacuacgcgagccugcggucccuggucgccucguccggcacgcucgaguucaacaacgagagcuucaacuggaccggggugacccagaacggcaccuccucggccugcauccgccgguccaacaacagcuucuucucccgccugaacuggcugacgcacucgaaguucaaguaccccgcccucaacgugaccaugcccaacaacgagaacuucgacaagcuguacaucuggggcguccaccaccccgggaccgacaacgaccagaucuuccuguacgcgcaggccuccgggcggaucaccgugagcacgaagcgcucgcagcagaccgugaucccgaacaucggcucccggccccgcguccggaacauccccagccgcaucuccaucuacuggaccaucgugaagcccggcgacauccuccugaucaacucgaccgggaaccugaucgccccgcggggcuacuucaagauccgcuccgggaaguccuccaucaugcggagcgacgcccccaucggcaagugcaacuccgagugcaucacgcccaacggcucgauccccaacgacaagccguuccagaacgugaaccgcaucaccuacggggccugcccccgguacgucaagcagaacacccucaagcuggcgaccggcaugcgcaacgugcccgagaagcagacgcgggggaucuucggcgccaucgccggguucaucgagaacggcugggagggcaugguggacgggugguacggcuuccgccaccagaacuccgaggggaucggccaggccgccgaccucaagagcacccaggcggccaucgaccagaucaacgggaagcugaaccggcugaucggcaagaccaacgagaaguuccaccagaucgagaaggaguucuccgagaucgagggccgcauccaggaccuggagaaguacgucgaggacaccaagaucgaccucuggucguacaacgccgagcugcugguggcccucgagaaccagcacacgaucgaccugaccgacuccgagaugaacaagcuguucgagaagaccaagaagcagcuccgggagaacgccgaggacauggggaacggcugcuucaagaucuaccacaagugcgacaacgcgugcaucgggagcauccgcaacggcaccuacgaccacgacguguaccgcgacgaggcccugaacaaccgguuccagaucaagggggucgagcugaaguccggcuacaaggacuggauccucuggaucagcuucgccaucuccugcuuccugcugugcaucgcccuccugggcuucaucaugugggccugccagaaggggaacauccgcugcaacaucugcaucuga

SEQ ID NO: 2829 - RNA, 1701 nt, Artificial Sequence
  derived and/or modified CDS sequence (AUadapt) from InfluenzaA__ACO36364__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccucggggcggaucaccguguccacgaagcgcagccagcagaccgugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggaccggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacacgaagaucgaccugugguccuacaacgccgagcuccugguggcccuggagaaccagcacaccaucgaccucaccgacucggagaugaacaagcuguucgagaagaccaagaagcagcugcgggagaacgccgaggacauggggaacggcugcuucaagaucuaccacaagugcgacaacgcgugcaucggguccauccgcaacggcacguacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 2830 - RNA, 1701 nt, Artificial Sequence; identical to SEQ ID NO: 2546
  derived and/or modified CDS sequence (AUadapt) from InfluenzaA__ACO36375__HA

SEQ ID NO: 2831 - RNA, 1698 nt, Artificial Sequence; identical to SEQ ID NO: 2733
  derived and/or modified CDS sequence (AUadapt) from InfluenzaA__ACO36397__HA

SEQ ID NO: 2832 - RNA, 1701 nt, Artificial Sequence; identical to SEQ ID NO: 2546
  derived and/or modified CDS sequence (AUadapt) from InfluenzaA__ACO36408__HA

SEQ ID NO: 2833 - RNA, 1701 nt, Artificial Sequence; identical to SEQ ID NO: 2173
  derived and/or modified CDS sequence (AUadapt) from InfluenzaA__ACO36419__HA

SEQ ID NO: 2834 - RNA, 1701 nt, Artificial Sequence; identical to SEQ ID NO: 2173
  derived and/or modified CDS sequence (AUadapt) from InfluenzaA__ACO36430__HA

SEQ ID NO: 2835 - RNA, 1701 nt, Artificial Sequence
  derived and/or modified CDS sequence (AUadapt) from InfluenzaA__ACO36441__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucgacuggaccggcgugacccagaacgggaccuccagcgccugcaagcgccgguccaacaagucguucuucucccgccugaacuggcucacgcaccugaaguacaaguaccccgcccugaacgugaccaugcccaacaacgagaaguucgacaagcucuacaucuggggcguccaccaccccgggaccgacucggaccagaucucccuguacgcgcaggccagcggccggaucaccgugucgacgaagcgcucccagcagaccgugaucccgaacaucggcucgcggccccgcguccgggacguguccagccgcaucuccaucuacuggaccaucgugaagcccggggacauccugcucaucaacucgaccggcaaccugaucgcgccccggggguacuucaagauccgcuccggcaagucguccaucaugcggagcgacgccccgaucggcaagugcaacuccgagugcaucacgcccaacgggucgauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacguggaggacacgaagaucgaccuguggucguacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacguguaccgggacgaggcccucaacaaccgcuuccagaucaagggcguggagcugaaguccggcuacaaggacuggauccuguggaucucguucgccaucagcugcuuccuccugugcgucgcccugcucggguucaucaugugggccugccagaagggcaacauccggugcgacaucugcaucuga

SEQ ID NO: 2836 - RNA, 1701 nt, Artificial Sequence
  derived and/or modified CDS sequence (AUadapt) from InfluenzaA__ACO36452__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagagcuucgacuggaccggcgugacccagaacgggaccuccucguccugcaagcgccggucgaacaacuccuucuucagccgccugaacuggcucacgcaccugaaguacaaguaccccgcccugaacgugaccaugcccaacaacgagaaguucgacaagcucuacaucuggggcguccaccaccccgggaccgacuccgaccagaucucgcuguacgcccaggcgagcggccggaucaccaucuccacgaagcgcucgcagcagaccgugaucccgaacaucggcucccggccccgcgugcgggacgucucgucccgcaucagcaucuacuggaccaucgugaagcccggggacauccugcucaucaacuccaccggcaaccugaucgcgccccggggguacuucaagauccgcucgggcaaguccagcaucaugcgguccgacgccccgaucggcaagugcaacucggagugcaucacgcccaacggguccauccccaacgacaagcccuuccagaacgugaaccgcaucaccuacggcgccugcccgcgguacgucaagcagaacacccugaagcucgccaccgggaugcgcaacgugcccgagaagcagacgcggggcaucuucggggccaucgccggcuucaucgagaacggcugggaggggaugguggacggcugguacggguuccgccaccagaacucggagggcaccgggcaggccgccgaccugaaguccacccaggccgcgaucaaccagaucaacggcaagcugaaccggcucaucggcaagaccaacgagaaguuccaccagaucgagaaggaguucagcgaggucgaggggcgcauccaggaccuggagaaguacguggaggacacgaagaucgaccugugguccuacaacgccgagcuccugguggcccuggagaaccagcacaccaucgaccucaccgacucggagaugaacaagcuguucgagcggaccaagaagcagcugcgcgagaacgccgaggacaugggcaacgggugcuucaagaucuaccacaagugcgacaacgccugcaucggcuccauccgcaacgggacguacgaccacgacgucuaccgggacgaggcgcucaacaaccgcuuccagaucaagggcguggagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 2837 - RNA, 1701 nt, Artificial Sequence
  derived and/or modified CDS sequence (AUadapt) from InfluenzaA__ACO36463__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucaucgagcgcucgaaggccuacuccaacugcuaccccuacgacgugccggacuacgcgagccugcggucccucguggccucguccgggacgcuggaguucaacaacgagucguucaacuggaccggcgucacccagaacgggaccuccagcgccugccagcgccgguccaacaagucguucuucucccgccugaacuggcucacgcaccugaaguucaaguaccccgcccugaacgugaccaugcccaacaacgagaaguucgacaagcucuacaucuggggcgugcaccaccccgggaccgacaacgaccagaucucgcuguacgcgcagaccuccggccggaucacggucagcaccaagcgcucgcagcagaccgugaucccgaacaucggcucccggccccgcgugcgggacguccccucgcgcaucuccaucuacuggaccaucgugaagcccggggacauccugcucaucaacagcacgggcaaccugaucgccccgcggggguacuucaagauccgcuccggcaagucguccaucaugcggucggacgcccccaucggcaagugcaacuccgagugcaucacccccaacgggagcauccccaacgacaagccguuccagaacgugaaccgcaucaccuacggcgccugcccccgguacgucaagcagaacacccugaagcucgccacggggaugcgcaacgugcccgagcggcagacccgcggcaucuucggggcgaucgccggcuucaucgagaacggcugggaggggaugguggacggcugguacggguuccggcaccagaacuccgagggcaccgggcaggccgccgaccugaaguccacccaggccgcgaucaaccagaucaacggcaagcugaaccgccucaucggcaagacgaacgagaaguuccaccagaucgagaaggaguucuccgaggucgaggggcggauccaggaccuggagaaguacguggaggacaccaagaucgaccuguggucguacaacgccgagcuccugguggcccuggagaaccagcacaccaucgaccucaccgacuccgagaugaacaagcuguucgagcgcacgaagaagcagcugcgcgagaacgccgaggacaugggcaacgggugcuucaagaucuaccacaagugcgacaacgccugcaucggcucgauccggaacgggaccuacgaccacgacgucuaccgcgacgaggcgcucaacaaccgguuccagaucaagggcguggagcugaaguccggcuacaaggacuggauccuguggaucagcuucgccaucuccugcuucgugcucugcgucgcccugcugggguucaucaugugggccugccagaagggcaacauccgcugcaacaucugcaucuga

SEQ ID NO: 2838 - RNA, 1701 nt, Artificial Sequence
  derived and/or modified CDS sequence (AUadapt) from InfluenzaA__ACO36474__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagagcuucgacuggaccggcgugacccagaacgggaccuccucguccugcaagcgccggucgaacaacuccuucuucagccgccugaacuggcucacgcaccuccgguacaaguaccccgcccugaacgugaccaugcccaacaacgagaaguucgacaagcuguacaucuggggcguccaccaccccgggaccgacuccgaccagaucucgcuguacgcccaggcgagcggccgcaucaccguguccacgaagcggucgcagcagaccgugaucccgaacaucggcucccgcccccggguccgcgacgugucgucccggaucagcaucuacuggaccaucgugaagcccggggacauccugcucaucaacuccaccggcaaccugaucgcgccccgcggguacuucaagauccggucgggcaaguccagcaucaugcgcuccgacgccccgaucggcaagugcaacucggagugcaucacgcccaacggguccauccccaacgacaagcccuuccagaacgucaaccggaucaccuacggcgacugcccgcgcuacgugaagcagaacacccugaagcucgccaccgggaugcggaacgugcccgagaagcagacgcgcggcaucuucggggccaucgccggcuucaucgagaacggcugggaggggauggucgacggcugguacggguuccggcaccagaacucggagggcaccgggcaggccgccgaccugaaguccacccaggccgccaucaaccagaucaacggcaagcugaaccgccucaucggcaagaccaacgagaaguuccaccagaucgagaaggaguucagcgagguggaggggcggauccaggaccuggagaaguacguggaggacacgaagaucgaccugugguccuacaacgcggagcuccuggucgcccuggagaaccagcacaccaucgaccucaccgacucggagaugaacaagcuguucgagcgcaccaagaagcagcugcgcgagaacgccgaggacaugggcaacgggugcuucaagaucuaccacaagugcgacaacgccugcaucggcuccauccggaacgggacguacgaccacgacguguaccgcgacgaggcccucaacaaccgguuccagaucaagggcguggagcugaaguccggcuacaaggacuggauccuguggaucagcuucgcgaucuccugcuuccuccugugcgucgcccugcucggguucaucaugugggccugccagaagggcaacauccgcugcaacaucugcaucuga

SEQ ID NO: 2839 - RNA, 1701 nt, Artificial Sequence
  derived and/or modified CDS sequence (AUadapt) from InfluenzaA__ACO36496__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucaacuggaccggcgugacccagaacgggaccuccagcgccugcaagcgccgguccaacaacggcuucuucucgcgccugaacuggcucacgcaccugaaguucaaguaccccgcccugaacgugaccaugcccaacaacgagaaguucgacaagcucuacaucuggggcguccaccaccccgggaccgacaacgaccagaucucccuguacgcgcaggccucgggccggaucaccguguccacgaagcgcagccagcagaccgugaucccgaacaucgggucgcggccccgcguccgggacaucuccucgcgcaucuccaucuacuggaccaucgugaagcccggcgacauccugcucaucaacagcaccgggaaccugaucgcgccccggggcuacuucaagauccgcuccggcaagucguccaucaugcggucggacgccccgaucgggaagugcaacuccgagugcaucacgcccaacggcagcauccccaacgacaagcccuuccagaacgugaaccgcaucaccuacggggccugcccgcgguacgucaagcagaacacccugaagcucgccaccggcaugcgcaacgugcccgagacgcagacccgggggaucuucggcgccaucgccggcuucaucgagaacgggugggagggcaugguggacgggugguacggcuuccgccaccagaacuccgaggggaccggccaggccgccgaccugaaguccacccaggcggccaucaaccagaucaacggcaagcugaaccggcucaucgggaagacgaacgagaaguuccaccagaucgagaaggaguucuccgaggucgagggccgcauccaggaccuggagaaguacguggaggacaccaagaucgaccuguggucguacaacgccgagcuccugguggcccuggagaaccagcacaccaucgaccucaccgacuccgagaugaacaagcuguucgagcggacgaagaagcagcugcgcgagaacgccgaggacauggggaacggcugcuucaagaucuaccacaagugcgacaacgcgugcaucgggucgauccgcaacggcaccuacgaccacgacgucuaccgggacgaggcccucaacaaccgcuuccagaucaagggcguggagcugaaguccggguacaaggacuggauccuguggaucagcuucgccaucuccugcuuccuccugugcguggcccugcucggcuucaucaugugggccugccagaaggggaacauccggugcaacaucugcaucuga

SEQ ID NO: 2840 - RNA, 1701 nt, Artificial Sequence
  derived and/or modified CDS sequence (AUadapt) from InfluenzaA__ACO36518__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucaacuggaccggcgugacccagaacgggaccuccagcgccugcaagcgccgguccaacaagucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucucgcuguacgcgcaggccuccggccggaucaccgugagcacgaagcgcucgcagcagaccgugaucccgaacaucggcucccggccccgcguccgggacgugcccucgcgcaucuccaucuacuggaccaucgugaagcccggggacauccugcucaucaacagcaccggcaaccugaucgccccgcggggguacuucaagauccgcuccggcaagucguccaucaugcggucggacgcccccaucggcaagugcaacuccgagugcaucacgcccaacgggagcauccccaacgacaagccguuccagaacgucaaccgcaucaccuacgggaccugcccccgguacgugaagcagaacacccugaagcucgccacgggcaugcgcaacgugcccgagaagcagacccggggcaucuucggggcgaucgccggcuucaucgagaacggcugggaggggauggucgacggcugguacggguuccgccaccagaacuccgagggcaccgggcaggccgccgaccugaaguccacccaggccgcgaucaaccagaucaacggcaagcugaaccggcucaucggcaagacgaacgagaaguuccaccagaucgagaaggaguucuccgagguggaggggcgcauccaggaccuggagaaguacguggaggacaccaagaucgaccuguggucguacaacgccgagcuccuggucgcccuggagaaccagcacaccaucgaccucaccgacuccgagaugaacaagcuguucgagcggacgaagaagcagcugcgcgagaacgccgaggacaugggcaacgggugcuucaagaucuaccacaagugcgacaacgccugcaucggcucgauccgcaacgggaccuacgaccacgacguguaccgggacgaggcgcucaacaaccgcuuccagaucaagggcguggagcugaagcugggcuacaaggacuggauccucuggaucuccuucgccaucagcugcuuccugcugugcgucgcccuccugggguucaucaugugggccugccagaagggcaacauccggugcaacaucugcaucuga

SEQ ID NO: 2841 - RNA, 1701 nt, Artificial Sequence
  derived and/or modified CDS sequence (AUadapt) from InfluenzaA__ACO36551__HA
augaagaccaucaucgcccugucgcacauccucugccugguguucgcccagaagcccccgggcaacgacaacuccaccgcgacgcugugccucgggcaccacgccguccccaacggcaccaucgugaagaccaucaccaacgaccagaucgaggugacgaacgccaccgagcugguccagucguccucgaccgggggcaucugcgacagcccccaccagauccuggacggggagaacugcacccucaucgacgcccugcugggcgacccccagugcgacggcuuccagaacaagaagugggaccucuucguggagcgcuccaaggccuacuccaacugcuacccguacgacgugcccgacuacgcgucgcugcggucccuggucgccucguccgggacgcucgaguucaacaacgagucguucaacuggaccggcgugacccagaacgggaccuccagcgccugcaagcgccgguccaacaacucguucuucucccgccugaacuggcugacgcaccucaaguucaaguaccccgcccugaacgugaccaugcccaacaacgagaaguucgacaagcuguacaucuggggcguccaccacccggggaccgacaacgaccagaucucgcucuacgcgcaggccuccggccggaucaccgugagcacgaagcgcucgcagcagaccgugauccccaacaucggcucccggccccgcguccgggacaucucgucccgcaucucgaucuacuggaccaucgugaagcccggggacauccugcugaucaacuccaccggcaaccucaucgccccgcggggguacuucaagauccgcagcggcaaguccucgaucaugcgguccgacgcccccaucggcaagugcaacucggagugcaucacgcccaacggguccauccccaacgacaagccguuccagaacgugaaccgcaucaccuacggcgccugcccccgguacgucaagcagaacacccugaagcuggcgaccgggaugcgcaacgugcccgagacgcagacccggggcaucuucggggccaucgccggcuucaucgagaacggcugggaggggaugguggacggcugguacggguuccgccaccagaacucggagggcaccgggcaggccgccgaccucaaguccacccaggcggccaucaaccagaucaacggcaagcugaaccggcugaucggcaagacgaacgagaaguuccaccagaucgagaaggaguucagcgaggucgaggggcgcauccaggaccucgagaaguacguggaggacaccaagaucgaccugugguccuacaacgccgagcugcucguggcccuggagaaccagcacaccaucgaccugaccgacucggagaugaacaagcuguucgagcggacgaagaagcagcuccgcgagaacgccgaggacaugggcaacgggugcuucaagaucuaccacaagugcgacaacgcgugcaucggcuccauccgcaacgagaccuacgaccacgacgucuaccgggacgaggcccugaacaaccgcuuccagaucaaggggguggagcucaagucgggcuacaaggacuggauccuguggaucuccuucgccaucagcugcuuccugcucugcguggcccugcugggcuucaucaugugggccugccagaaggggaacauccggugcaacaucugcaucuga

SEQ ID NO: 2842 - RNA, 1701 nt, Artificial Sequence
  derived and/or modified CDS sequence (AUadapt) from InfluenzaA__ACO36562__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucaacuggaccggcgugacccagaacgggaccuccagcgccugcaagcgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucucgcuguacgcgcaggccuccggccggaucaccgugagcacgaagcgcucgcagcagaccgugaucccgaacaucggcucccggccccgcguccgggacauccccucgcgcaucuccaucuacuggaccaucgugaagcccggggacauccugcucaucaacagcaccggcaaccugaucgccccgcggggguacuucaagauccgcuccggcaagucguccaucaugcggucggacgcccccaucggcaagugcaacuccgagugcaucacgcccaacgggagcauccccaacgacaagccguuccagaacgugaaccgcaucaccuacggcgccugcccccgguacgucaagcagaacacccugaagcucgcgaccgggaugcgcaacgugcccgagacgcagacccggggcaucuucggggccaucgccggcuucaucgagaacggcugggaggggaugguggacggcugguacggguuccgccaccagaacuccgagggcaccgggcaggccgccgaccugaaguccacccaggcggccaucaaccagaucaacggcaagcugaaccggcucaucggcaagacgaacgagaaguuccaccagaucgagaaggaguucuccgaggucgaggggcgcauccaggaccuggagaaguacguggaggacaccaagaucgaccuguggucguacaacgccgagcuccugguggcccuggagaaccagcacaccaucgaccucaccgacuccgagaugaacaagcuguucgagcggacgaagaagcagcugcgcgagaacgccgaggacaugggcaacgggugcuucaagaucuaccacaagugcgacaacgcgugcaucggcucgauccgcaacgagaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 2843 - RNA, 1701 nt, Artificial Sequence
  derived and/or modified CDS sequence (AUadapt) from InfluenzaA__ACO36573__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucaacuggaccggcgugacccagaacgggaccuccagcgccugcaagcgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucaccgugucgacgaagcgcucgcagcagaccgugaucccgaacaucggcucccggccccgcguccgggacaucagcucccgcaucucgaucuacuggaccaucgugaagcccggggacauccugcucaucaacuccaccggcaaccugaucgcgccccggggguacuucaagauccgcucgggcaaguccagcaucaugcgguccgacgccccgaucggcaagugcaacucggagugcaucacgcccaacggguccauccccaacgacaagcccuuccagaacgugaaccgcaucaccuacggcgccugcccgcgguacgucaagcagaacacccugaagcucgccaccgggaugcgcaacgugcccgagacgcagacccggggcaucuucggggccaucgccggcuucaucgagaacggcugggaggggaugguggacggcugguacggguuccgccaccagaacucggagggcaccgggcaggccgccgaccugaaguccacccaggcggccaucaaccagaucaacggcaagcugaaccggcucaucggcaagacgaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacaccaucgaccucaccgacucggagaugaacaagcuguucgagcggacgaagaagcagcugcgcgagaacgccgaggacaugggcaacgggugcuucaagaucuaccacaagugcgacaacgcgugcaucggcuccauccgcaacgagaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 2844 - RNA, 1701 nt, Artificial Sequence
  derived and/or modified CDS sequence (AUadapt) from InfluenzaA__ACO36584__HA
augaagaccaucaucgcccugucguacauccucugccugguguucucccagaagcugcccggcaacgacaacucgaccgccacgcucugccuggggcaccacgcggucccgaacggcaccaucgugaagaccaucaccaacgaccagaucgaggugacgaacgccaccgagcugguccaguccagcuccaccgggggcaucugcgacucgccccaccagauccucgacggggagaacugcacccugaucgacgcccugcucggcgacccccagugcgacggcuuccagaacaagaagugggaccuguucguggagcgcuccaaggccuacucgaacugcuaccccuacgacgugccggacuacgccucccugcggagccucgucgcguccucggggacgcuggaguucaacaacgaguccuucaacuggaccggcgugacccagaacgggaccagcuccgccugcaagcgccggucgaacaacuccuucuucucgcgccugaacuggcucacgcaccugaaguucaaguaccccgcccugaacgugaccaugcccaacaacgagaaguucgacaagcucuacaucuggggcguccaccaccccgggaccgacaacgaccagaucucccuguacgcccaggcgagcggccggaucaccgugucgacgaagaagucccagcagaccgugaucccgaacaucggcagccgcccccggguccgcgacaucuccucgcggaucuccaucuacuggaccaucgugaagcccggggacauccugcucaucaacucgaccggcaaccugaucgcgccccgcggguacuucaagauccgguccggcaagagcuccaucaugcgcucggacgccccgaucggcaagugcaacuccgagugcaucacgcccaacgggagcauccccaacgacaagcccuuccagaacgugaaccggaucaccuacggcgccugcccgcgcuacgucaagcagaacacccugaagcucgccaccgggaugcggaacgugcccgagacgcagacccgcggcaucuucggggccaucgccggcuucaucgagaacggcugggaggggaugguggacggcugguacggguuccggcaccagaacuccgagggcaccgggcaggccgccgaccucaagucgacccaggccgcgaucaaccagaucaacggcaagcugaaccgccugaucggcaagacgaacgagaaguuccaccagaucgagaaggaguucuccgaggucgaggggcggauccaggaccuggagaaguacguggaggacaccaagaucgaccuguggucguacaacgccgagcuccugguggcccuggagaaccagcacaccaucgaccucaccgacuccgagaugaacaagcuguucgagcgcacgaagaagcagcugcgggagaacgccgaggacaugggcaacgggugcuucaagaucuaccacaagugcgacaacgccugcaucggcagcauccgcaacgagaccuacgaccacgacgucuaccgcgacgaggcgcucaacaaccgguuccagaucaaggggguggagcugaaguccggcuacaaggacuggauccuguggaucucguucgccaucagcugcuuccuccugugcguggcccugcucggcuucaucaugugggccugccagaaggggaacauccgcugcaacaucugcaucuga

SEQ ID NO: 2845 - RNA, 1701 nt, Artificial Sequence; identical to SEQ ID NO: 875
  derived and/or modified CDS sequence (AUadapt) from InfluenzaA__ACO36595__HA

SEQ ID NO: 2846 - RNA, 1701 nt, Artificial Sequence
  derived and/or modified CDS sequence (AUadapt) from InfluenzaA__ACO36606__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucgucgccagcuccgggacgcuggaguucaagaacgagucguucaacuggaccggcgugacccagaacgggaccuccucggccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccucgggccggaucaccguguccacgcagcgcagccagcagaccgugaucccgaacaucggcucgcggccccgcguccggaacauccccucccgcaucagcaucuacuggaccaucgugaagcccggggacauccugcucaucaacuccaccggcaaccugaucgccccgcggggguacuucaagauccgcucgggcaaguccucgaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacucggagggcaucgggcaggccgccgaccugaaguccacccaggcggccaucaaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacacgaucgaccucaccgacucggagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 2847 - RNA, 1701 nt, Artificial Sequence; identical to SEQ ID NO: 875
  derived and/or modified CDS sequence (AUadapt) from InfluenzaA__ACO36617__HA

SEQ ID NO: 2848 - RNA, 1701 nt, Artificial Sequence; identical to SEQ ID NO: 875
  derived and/or modified CDS sequence (AUadapt) from InfluenzaA__ACO36628__HA

SEQ ID NO: 2849 - RNA, 1701 nt, Artificial Sequence
  derived and/or modified CDS sequence (AUadapt) from InfluenzaA__ACO36639__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucgucgccagcuccgggacgcuggaguucaacaacgagucguucaacuggaccggcgugacccagaacgggaccuccagcgccugcaagcgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcggccggaucaccguguccacgaagcgcucgcagcagaccgugaucccgaacaucggcagccggccccgcguccggaacauccccucccgcaucucgaucuacuggaccaucgugaagcccggggacauccugcucaucaacuccaccggcaaccugaucgccccgcggggguacuucaagauccgcagcggcaaguccucgaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacucggagggcaucgggcaggccgccgaccugaaguccacccaggcggccaucaaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacacgaucgaccucaccgacucggagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcuucgcccugcucggguucaucaugugggccugccagaagggcaacauccggugcaacaucugcaucuga

SEQ ID NO: 2850 - RNA, 1701 nt, Artificial Sequence
  derived and/or modified CDS sequence (AUadapt) from InfluenzaA__ACO36661__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucgucgccagcuccgggacgcuggaguucaacaacgagucguucaacuggaccggcgugacccagaacgggaccuccagcgccugcaagcgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcggccggaucaccguguccacgaagcgcucgcagcagaccgugaucccgaacaucggcagccggccccgcguccggaacauccccucccgcaucucgaucuacuggaccaucgugaagcccggggacauccugcucaucaacuccaccggcaaccugaucgccccgcggggguacuucaagauccgcagcggcaaguccucgaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacucggagggcaucgggcaggccgccgaccugaaguccacccaggcggccaucaaccagaucaacggcaagcugaaccggcucaucggcaagaccaacgagaaguuccaccagaucgagaaggaguucagcgaggucgaggggcgcauccaggaccuggagaaguacguggaggacaucaagaucgaccugugguccuacaacgccgagcuccugguggcccuggagaaccagcacaccaucgaccucacggacucggagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 2851 - RNA, 1701 nt, Artificial Sequence; identical to SEQ ID NO: 875
  derived and/or modified CDS sequence (AUadapt) from InfluenzaA__ACO36683__HA

SEQ ID NO: 2852 - RNA, 1701 nt, Artificial Sequence; identical to SEQ ID NO: 2842
  derived and/or modified CDS sequence (AUadapt) from InfluenzaA__ACO37122__HA

SEQ ID NO: 2853 - RNA, 1701 nt, Artificial Sequence
  derived and/or modified CDS sequence (AUadapt) from InfluenzaA__ACO94514__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgcaaguccaacaacagcuucuucucccggcugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccucggggcgcaucaccguguccacgaagcggagccagcagaccgugaucccgaacaucggcucgcgcccccggguccgcaacauccccucccggaucagcaucuacuggaccaucgugaagcccggcgacauccugcucaucaacuccaccgggaaccugaucgccccgcgcggcuacuucaagauccggucggggaaguccucgaucaugcgcuccgacgcccccaucggcaagugcaacagcgagugcaucacgcccaacggcuccauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggguucaucgagaacggcugggagggcaugguggacgggugguacggcuuccggcaccagaacucggaggggcgcggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 2854 - RNA, 1701 nt, Artificial Sequence
  derived and/or modified CDS sequence (AUadapt) from InfluenzaA__ACO94515__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgcaaguccaacaacagcuucuucucccggcugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccucggggcgcaucaccguguccacgaagcggagccagcagaccgugaucccgaacaucggcucgcgcccccggguccgcaacauccccucccggaucagcaucuacuggaccaucgugaagcccggcgacauccugcucaucaacuccaccgggaaccugaucgccccgcgcggcuacuucaagauccggucggggaaguccucgaucaugcgcuccgacgcccccaucggcaagugcaacagcgagugcaucacgcccaacggcuccauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggguucaucgagaacggcugggagggcaugauggacgggugguacggcuuccggcaccagaacucggaggggcgcggccaggccgccgaccugaaguccacccaggcggccaucgaccagaucaacgggaagcugaaccggcucaucggcaagaccaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacacgaucgaccucaccgacucggagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacguguaccgcgacgaggcccucaacaaccgguuccagaucaagggggucgagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 2855 - RNA, 1701 nt, Artificial Sequence; identical to SEQ ID NO: 2679
  derived and/or modified CDS sequence (AUadapt) from InfluenzaA__ACO94516__HA

SEQ ID NO: 2856 - RNA, 1701 nt, Artificial Sequence; identical to SEQ ID NO: 2679
  derived and/or modified CDS sequence (AUadapt) from InfluenzaA__ACO94672__HA

SEQ ID NO: 2857 - RNA, 1701 nt, Artificial Sequence
  derived and/or modified CDS sequence (AUadapt) from InfluenzaA__ACO94683__HA
augaagaccaucaucgcccugucguacauccucugccugguguccgcccagaagcugcccggcaacgacaacucgaccgcgacgcucugccuggggcaccacgccgucccgaacggcaccaucgugaagaccaucaccaacgaccagaucgaggugacgaacgccaccgagcugguccaguccagcuccaccggggagaucugcgacucgccccaccaggugcucgacggcgagaacugcacccugaucgacgcccugcucggggacccccagugcgacggcuuccagaacaagaagugggaccuguucguggagcgcuccaaggccuacucgaacugcuaccccuacgacgucccggacuacgcgucccugcggagccucguggccuccucgggcacgcuggaguucaacaacgaguccuucaacuggaccggggugacccagaacggcaccagcuccgccugcauccgccggucgaacaacuccuucuucucgcgccugaacuggcucacgcacuccaaguucaaguaccccgcccugaacgucaccaugcccaacaacgaggaguucgacaagcuguacaucuggggcgugcaccaccccgggaccgacaacgaccagaucuuccucuacgcgcaggccagcgggcggaucaccgugucgacgaagcgcucccagcagaccgucaucccgaacaucggcucgcggccccgcgugcggaacauccccucccgcaucagcaucuacuggaccaucgugaagcccggcgacauccugcugaucaacuccaccgggaaccucaucgccccgcggggcuacuucaagauccgcucggggaaguccagcaucaugcgguccgacgcccccaucggcaagugcaacucggagugcaucacgcccaacggcuccauccccaacgacaagccguuccagaacgucaaccgcaucaccuacggggccugcccccgguacgugaagcagaacacccugaagcuggcgaccggcaugcgcaacgugcccgagaagcagacgcgggggaucuucggcgccaucgccggguucaucgagaacggcugggagggcauggucgacgggugguacggcuuccgccaccagaacucggaggggaucggccaggccgccgaccucaaguccacccaggcggccaucgaccagaucaacgggaagcugaaccggcugaucggcaagaccaacgagaaguuccaccagaucgagaaggaguucaccgagguggagggccgcauccaggaccucgagaaguacguggaggacacgaagaucgaccuguggagcuacaacgccgagcugcucgucgcccuggagaaccagcacaccaucgaccugaccgacuccgagaugaacaagcuguucgagaagaccaagaagcagcuccgggagaacgccgaggacauggggaacggcugcuucaagaucuaccacaagugcgacaacgcgugcaucgggucgauccgcaacggcacguacgaccacgagguguaccgcgacgaggcccugaacaaccgguuccagaucaaggggguggagcucaaguccggcuacaaggacuggauccuguggaucagcuucgccaucuccugcuuccugcucugcgucgcccugcugggcuucaucaugugggccugccagaaggggaacauccgcugcaacaucugcaucuga

SEQ ID NO: 2858 - RNA, 1701 nt, Artificial Sequence; identical to SEQ ID NO: 2679
  derived and/or modified CDS sequence (AUadapt) from InfluenzaA__ACO94694__HA

SEQ ID NO: 2859 - RNA, 1698 nt, Artificial Sequence; identical to SEQ ID NO: 2733
  derived and/or modified CDS sequence (AUadapt) from InfluenzaA__ACO94705__HA

SEQ ID NO: 2860 - RNA, 1701 nt, Artificial Sequence
  derived and/or modified CDS sequence (AUadapt) from InfluenzaA__ACO94727__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacucguucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccagcgggcggaucaccguguccacgaagcgcucgcagcagaccgugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccagcaucaugaaguccgacgcccccaucggcaagugcaacucggagugcaucacgcccaacggcuccauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggguucaucgagaacggcugggagggcaugguggacgggugguacggcuuccggcaccagaacucggaggggcgcggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaaggggguggagcugaaguccggcuacaaggacuggauccuguggaucuccuucgccaucagcugccuccugcugugcguggcccuccugggcuucaucaugugggccugccagaaggggaacauccgcugcaacaucugcaucuga

SEQ ID NO: 2861 - RNA, 1701 nt, Artificial Sequence
  derived and/or modified CDS sequence (AUadapt) from InfluenzaA__ACO94738__HA
augaagaccaucaucgcccugucguacauccagugccucguguucgcccagaaguuccccggcaacgacaacuccaccgcgacgcugugccuggggcaccacgccgucccgaacggcaccguggugaagaccaucaccaacgaccagaucgaggucacgaacgccaccgagcucgugcagucguccagcaccggggagaucugcgacucgccccaccagauccuggacggcgagaacugcacccugaucgacgcccuccugggggacccccagugcgacggcuuccagaacaagaacugggaccuguucguggagcgcagcaaggccuacuccaacugcuaccccuacgacgucccggacuacgcgucgcuccggucccugguggccagcuccggcacgcuggaguucaacaacgagucguucaacuggaccggggugacccagaacggcaccuccagcgccugcauccgccgguccaacaacucguucuucucccgccucaacuggcugacgcacagcaaguucaaguaccccgcccugaacgucaccaugcccaacaacgagaacuucgacaagcucuacaucuggggcgugcaccaccccgggaccgacaacgaccagaucuuccuguacgcgcgggccuccgggcgcaucaccgugucgacgaagcggagccagcagaccgucaucccgaacaucggcucccgcccccgggugcgcaacauccccucgcggaucuccaucuacuggaccaucgugaagcccggcgacauccugcucaucaacagcaccgggaaccugaucgccccgcgcggcuacuucaagauccgguccgggaaguccuccaucaugcgcucggacgcccccaucggcaagugcaacuccgagugcaucacgcccaacggcagcauccccaacgacaagccguuccagaacgucaaccggaucaccuacggggccugcccccgcuacgugaagcagaacacccugaagcucgcgaccggcaugcggaacgugcccgagaagcagacgcgcgggaucuucggcgccaucgccggguucaucgagaacggcugggagggcauggucgacgggugguacggcuuccggcaccagaacuccgaggggaucggccaggccgccgaccucaagucgacccaggcggccaucgaccagaucaacgggaagcugaaccgccugaucggcaagaccaacgagaaguuccaccagaucgagaaggaguucuccgagguggagggccggauccaggaccuggagaaguacguggaggacaccaagaucgaccuguggagcuacaacgccgagcuccuggucgcccuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgcgugcaucgggucgauccgcaacggcaccuacgaccacgacguguaccgggacgaggcccucaacaaccgcuuccagaucaaggggguggagcugaaguccggcuacaaggacuggauccuguggaucagcuucgccaucuccugcuuccuccugugcaucgcccugcucggcuucaucaugugggccugccagaaggggaacauccggugcaacaucugcaucuga

SEQ ID NO: 2862 - RNA, 1701 nt, Artificial Sequence; identical to SEQ ID NO: 2782
  derived and/or modified CDS sequence (AUadapt) from InfluenzaA__ACO94760__HA

SEQ ID NO: 2863 - RNA, 1701 nt, Artificial Sequence
  derived and/or modified CDS sequence (AUadapt) from InfluenzaA__ACO94771__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacucguucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccagcgggcggaucaccguguccacgaagcgcucgcagcagaccgugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccagcaucaugcgguccgacgcccccaucggcaagugcaacucggagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggcggggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugccuccugcugugcguggcccuccugggcuucaucaugugggccugccagaaggggaacauccggugcaacaucugcaucuga

SEQ ID NO: 2864 - RNA, 1701 nt, Artificial Sequence; identical to SEQ ID NO: 2679
  derived and/or modified CDS sequence (AUadapt) from InfluenzaA__ACO94782__HA

SEQ ID NO: 2865 - RNA, 1701 nt, Artificial Sequence; identical to SEQ ID NO: 2679
  derived and/or modified CDS sequence (AUadapt) from InfluenzaA__ACO94793__HA

SEQ ID NO: 2866 - RNA, 1698 nt, Artificial Sequence
  derived and/or modified CDS sequence (AUadapt) from InfluenzaA__ACO94804__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagccgcgaguccuggucguacaucguggagaagcccaaccccgagaacgggaccugcuaccccggccacuucgccgacuacgaggagcugcgggagcagcucuccagcguguccagcuucgagcgcuucgagaucuucccgaaggaguccagcuggcccaaccacacgaccaccggggucuccgccucgugcucccacaacggcgagagcuccuucuacaagaaccugcuguggcucaccgggaagaacggccuguaccccaaccugagcaaguccuacgccaacaacaaggagaaggaggugcucgugcuguggggcguccaccacccgcccaacaucggcaaccagcgggcccuguaccacacggagaacgccuacgugucgguggucagcucccacuacagccgcaaguucacccccgagaucgccaagcggcccaaggugcgcgaccaggagggccggaucaacuacuacuggacccuccuggagcccggggacaccaucaucuucgaggcgaacggcaaccugaucgccccgcgcuacgccuucgcccucucccggggguucggcagcggcaucaucaacuccaacgcccccauggacgggugcgacgcgaagugccagacgccccagggcgccaucaacucgucccugcccuuccagaacgugcacccggucaccaucggggagugccccaaguacgugcgcagcgccaagcugcggauggugaccggccuccgcaacauccccuccauccagagccgggggcuguucggcgccaucgccggcuucaucgagggcggguggaccgggauggucgacggcugguacggguaccaccaccagaacgagcagggcuccggcuacgcggccgaccagaaguccacgcagaacgccaucaacgggaucaccaacaaggugaacucggugaucgagaagaugaacacccaguucaccgccgucggcaaggaguucaacaagcuggagcgccggauggagaaccucaacaagaagguggacgacggguucaucgacaucuggacguacaacgccgagcugcugguccuccuggagaacgagcgcacccuggacuuccacgacagcuacgugaagaaccucuacgagaaggugaagucccagcugaagaacaacgcgaaggagaucggcaacgggugcuucgaguucuaccacaagugcaacgacgagugcauggagagcgucaagaacggcaccuacgacuaccccaaguacuccgaggagagcaagcugaaccgggagaagaucgacggcgugaagcucgaguccauggggguguaccagauccuggccaucuacucgaccgucgccagcucccuggugcuccuggugagccugggcgccaucuccuucuggaugugcagcaacgggucccuccagugccgcaucugcaucuga

SEQ ID NO: 2867 - RNA, 1701 nt, Artificial Sequence; identical to SEQ ID NO: 2546
  derived and/or modified CDS sequence (AUadapt) from InfluenzaA__ACO94815__HA

SEQ ID NO: 2868 - RNA, 1701 nt, Artificial Sequence; identical to SEQ ID NO: 2553
  derived and/or modified CDS sequence (AUadapt) from InfluenzaA__ACO94848__HA

SEQ ID NO: 2869 - RNA, 1698 nt, Artificial Sequence; identical to SEQ ID NO: 2733
  derived and/or modified CDS sequence (AUadapt) from InfluenzaA__ACO94859__HA

SEQ ID NO: 2870 - RNA, 1698 nt, Artificial Sequence
  derived and/or modified CDS sequence (AUadapt) from InfluenzaA__ACO94870__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccucguggcccaaccacacggucaccgggguguccgccagcugcucccacaacggcgagagcuccuucuaccgcaaccugcuguggcucaccgggaagaacggccuguaccccaaccugucgaaguccuacgccaacaacaaggggaaggaggugcucguccuguggggcgugcaccacccgcccaacaucggcgaccagaacacccuguaccacacggagaacgccuacgugagcgucgugagcucccacuacucgcggaaguucacccccgagaucgccaagcgccccaaggugcgggaccaggaggggcgcaucaacuacuacuggacccuccuggagcccggcgacaccaucaucuucgaggccaacgggaaccugaucgcgccgcgguacgccuucgcccucaaccgcggcuucggcuccgggaucaucaacagcaacgcccccauggacaagugcgacgccaagugccagacgccccagggcgcgaucaacuccagccugcccuuccagaacguccacccggugaccaucggggagugccccaaguacgugcgguccgccaagcugcgcauggucaccggccuccggaacauccccucgauccagucccgcgggcuguucggcgccaucgccggcuucaucgagggcggcuggaccgggaugguggacggcugguacggguaccaccaccagaacgagcagggcagcggcuacgccgcggaccagaaguccacgcagaacgccaucaacgggaucaccaacaaggugaacagcgucaucgagaagaugaacacccaguucaccgccgugggcaaggaguucaacaagcuggagcggcgcauggagaaccucaacaagaaggucgacgacggguucaucgacaucuggacguacaacgccgagcugcuggugcuccuggagaacgagcggacccuggacuuccacgacuccaacgugaagaaccucuacgagaaggucaagucgcagcugaagaacaacgccaaggagaucggcaacgggugcuucgaguucuaccacaagugcaacgacgagugcauggaguccgugaagaacggcaccuacgacuaccccaaguacagcgaggaguccaagcugaaccgcgagaagaucgacggcgugaagcucgagagcaugggggucuaccagauccuggcgaucuacuccaccguggccucgagccuggugcuccuggucucccugggcgccaucagcuucuggaugugcuccaacgggagccuccagugccggaucugcaucuga

SEQ ID NO: 2871 - RNA, 1701 nt, Artificial Sequence
  derived and/or modified CDS sequence (AUadapt) from InfluenzaA__ACO94881__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagagcuucgacuggaccggcgugacccagaacgggaccuccucguccugcaagcgccggucgaacaacuccuucuucagccgccugaacuggcucacgcaccugaaguacaaguaccccgcccugaacgugaccaugcccaacaacgagaaguucgacaagcucuacaucuggggcguccaccaccccgggaccgacuccgaccagaucucgcuguacgcccaggcgagcggccggaucaccguguccacgaagcgcucgcagcagaccgugaucccgaacaucggcucccggccccgcguccgggacgugucgucccgcaucagcaucuacuggaccaucgugaagcccggggacauccugcucaucaacuccaccggcaaccugaucgcgccccggggguacuucaagauccgcucgggcaaguccagcaucaugcgguccgacgccccgaucggcaagugcaacucggagugcaucacgcccaacggguccauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacucggagggcaccgggcaggccgccgaccugaaguccacccaggccgcgaucaaccagaucaacggcaagcugaaccggcucaucggcaagaccaacgagaaguuccaccagaucgagaaggaguucagcgagguggaggggcgcauccaggaccuggagaaguacguggaggacacgaagaucgaccugugguccuacaacgccgagcuccuggucgcccuggagaaccagcacaccaucgaccucaccgacucggagaugaacaagcuguucgagcggaccaagaagcagcugcgcgagaacgccgaggacaugggcaacgggugcuucaagaucuaccaccgcugcgacaacgccugcaucggcuccauccggaacgggacguacgaccacgacguguaccgcgacgaggcgcucaacaaccgguuccagaucaagggcguggagcugaaguccggcuacaaggacuggauccuguggaucagcuucgccaucuccugcuuccuccugugcgucgcccugcucggguucaucaugugggccugccagaagggcaacauccgcugcaacaucugcaucuga

SEQ ID NO: 2872 - RNA, 1701 nt, Artificial Sequence
  derived and/or modified CDS sequence (AUadapt) from InfluenzaA__ACO94892__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagagcuucaacuggaccggcgugacccagaacgggaccuccucggccugccagcgccgguccaacaagucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcagaccuccggccggaucacgaucucgaccaagcgcucgcagcagaccgugaucccgaacaucggcucccggccccgcgugcgggacguccccagccgcaucuccaucuacuggaccaucgugaagcccggggacauccugcucaucaacucgacgggcaaccugaucgccccgcggggguacuucaagauccgcuccggcaagagcuccaucaugcggucggacgcccccaucgugaagugcaacuccgagugcaucacccccaacggcucgauccccaacgacaagccguuccagaacgucaaccgcaucaccuacggggccugcccccgguacgugaagcagaacacccugaagcucgccacgggcaugcgcaacgugcccgagcggcagacccgcgggaucuucggcgcgaucgccggguucaucgagaacggcugggagggcauggucgacgggugguacggcuuccggcaccagaacuccgaggggaccggccaggccgccgaccugaaguccacccaggccgcgaucaaccagaucaacgggaagcugaaccgccucaucggcaagacgaacgagaaguuccaccagaucgagaaggaguucuccgagguggagggccggauccaggaccuggagaaguacguggaggacaccaagaucgaccuguggagcuacaacgccgagcuccuggucgcccuggagaaccagcacaccaucgaccucaccgacuccgagaugaacaagcuguucgagcgcacgaagaagcagcugcgcgagaacgccgaggacauggggaacggcugcuucaagaucuaccacaagugcgacaacgccugcaucgggucgauccggaacggcaccuacgaccacgacguguaccgcgacgaggcgcucaacaaccgguuccagaucaaggggguggagcugaaguccggcuacaaggacuggauccuguggaucagcuucgccaucuccugcuuccuccugugcgucgcccugcucggcuucaucaugugggccugccagaaggggaacauccgcugcaacaucugcaucuga

SEQ ID NO: 2873 - RNA, 1701 nt, Artificial Sequence
  derived and/or modified CDS sequence (AUadapt) from InfluenzaA__ACO94903__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucggaggccuacuccaacugcuaccccuacgacgugccggacuacgcgagccugcggucccucgucgccucguccgggacgcuggaguucaacaacgagucguucaacuggaccggcgugacccagaacgggaccuccagcgccugcaagcgccgguccaacaagucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucucgcuguacgcgcaggccuccggccggaucaccgugagcacgaagcgcucgcagcagaccgugaucccgaacaucggcucccggccccgcguccgggacgugcccucgcgcaucuccaucuacuggaccaucgugaagcccggggacauccugcucaucaacagcaccggcaaccugaucgccccgcggggguacuucaagauccgcuccggcaagucguccaucaugcggucggacgcccccaucggcaagugcaacuccgagugcaucacgcccaacgggagcauccccaacgacaagccguuccagaacgucaaccgcaucaccuacggcgccugcccccgguacgugaagcagaacacccugaagcucgcgaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacguggaggacacgaagaucgaccuguggucguacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcucgauccgcaacgggacguacgaccacgacguguaccgggacgaggcccucaacaaccgcuuccagaucaagggcguggagcugaaguccggcuacaaggacuggauccuguggaucagcuucgccaucuccugcuuccuccugugcgucgcccugcucggguucaucaugugggccugccagaagggcaacauccggugcaacaucugcaucuga

SEQ ID NO: 2874 - RNA, 1701 nt, Artificial Sequence
  derived and/or modified CDS sequence (AUadapt) from InfluenzaA__ACO94925__HA
augaagaccaucaucgcccugucguacauccucugccugguguucgcccagaagcugcccggcaacgacaacuccaccgcgacgcucugccuggggcaccacgccgucccgaacggcaccguggugaagaccaucaccaacgaccagaucgaggucacgaacgccaccgagcuggugcagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgucccggacuacgcgagccugcggucccucguggccucguccgggacgcuggaguucaacaacgagucguucaacuggaccggcgugacccagaacgggaccuccagcgccugcaagcgccgguccaacaagucguucuucucccgccugaacuggcucacgcaccugaaguucaaguaccccgcccugaacgucaccaugcccaacaacgagaaguucgacaagcucuacaucuggggcgugcaccaccccgggaccgacaacgaccagaucucgcuguacgcgcaggccuccggccggaucaccgugagcacgaagcgcucgcagcagaccgucaucccgaacaucggcucccggccccgcgugcgggacgugcccucgcgcaucuccaucuacuggaccaucgucaagcccggggacauccugcucaucaacagcaccggcaaccugaucgccccgcggggguacuucaagauccgcuccggcaagucguccaucaugcggucggacgcccccaucggcaagugcaacuccgagugcaucacgcccaacgggagcauccccaacgacaagccguuccagaacgugaaccgcaucaccuacggcgccugcccccgguacgugaagcagaacacccugaagcucgcgaccgggaugcgcaacguccccgagaagcagacgcggggcaucuucggggccaucgccggcuucaucgagaacggcugggaggggaugguggacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacgucgaggacacgaagaucgaccuguggucguacaacgccgagcuccugguggcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcucgauccgcaacgggacguacgaccacgacguguaccgggacgaggcccucaacaaccgcuuccagaucaagggcgucgagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 2875 - RNA, 1701 nt, Artificial Sequence
  derived and/or modified CDS sequence (AUadapt) from InfluenzaA__ACO94936__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggaggacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagagcuucgacuggaccggcgugacccagaacgggaccuccucguccugcaagcgccggucgaacaacuccuucuucagccgccugaacuggcucacgcaccugaaguacaaguaccccgcccugaacgugaccaugcccaacaacgagaaguucgacaagcucuacaucuggggcguccaccaccccgggaccgacuccgaccagaucucgcuguacgcccaggcgagcggccggaucaccguguccacgaagcgcucgcagcagaccgugaucccgaacaucggcucccggccccgcguccgggacgugucgucccgcaucagcaucuacuggaccaucgugaagcccggggacauccugcucaucaacuccaccggcaaccugaucgcgccccggggguacuucaagauccgcucgggcaaguccagcaucaugcgguccgacgccccgaucggcaagugcaacucggagugcaucacgcccaacggguccauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacucggagggcaccgggcaggccgccgaccugaaguccacccaggccgcgaucaaccagaucaacggcaagcugaaccggcucaucggcaagaccaacgagaaguuccaccagaucgagaaggaguucagcgagguggaggggcgcauccaggaccuggagaaguacguggaggacacgaagaucgaccugugguccuacaacgccgagcuccuggucgcccuggagaaccagcacaccaucgaccucaccgacucggagaugaacaagcuguucgagcggaccaagaagcagcugcgcgagaacgccgaggacaugggcaacgggugcuucaagaucuaccacaagugcgacaacgccugcaucggcuccauccgcaacgggacguacgaccacgacguguaccgggacgaggcgcucaacaaccgcuuccagaucaagggcguggagcugaaguccggcuacaaggacuggauccuguggaucagcuucgccaucuccugcuuccuccugugcgucgcccugcucggguucaucaugugggccugccagaagggcaacauccggugcaacaucugcaucuga

SEQ ID NO: 2876 - RNA, 1701 nt, Artificial Sequence
  derived and/or modified CDS sequence (AUadapt) from InfluenzaA__ACO94947__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucaacuggaccggcgugacccagaacgggaccuccagcgccugcaagcgccgguccaacaagucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucucgcuguacgcgcaggccuccggccggaucaccgugagcacgaagcgcucgcagcagaccgugaucccgaacaucggcucccggccccgcguccgggacgugcccucgcgcaucuccaucuacuggaccaucgugaagcccggggacauccugcucaucaacagcaccggcaaccugaucgccccgcggggguacuuccgcauccgguccggcaagucguccaucaugcgcucggacgcccccaucggcaagugcaacuccgagugcaucacgcccaacgggagcauccccaacgacaagccguuccagaacgucaaccggaucaccuacggcgccugcccccgcuacgugaagcagaacacccugaagcucgcgaccgggaugcggaacgugcccgagaagcagacgcgcggcaucuucggggccaucgccggcuucaucgagaacggcugggaggggauggucgacggcugguacggguuccggcaccagaacuccgagggcaccgggcaggccgccgaccugaaguccacccaggcggccaucaaccagaucaacggcaagcugaaccgccucaucggcaagaccaacgagaaguuccaccagaucgagaaggaguucuccgagguggaggggcggauccaggaccuggagaaguacguggaggacacgaagaucgaccuguggucguacaacgccgagcuccuggucgcccuggagaaccagcacaccaucgaccucaccgacuccgagaugaacaagcuguucgagcgcaccaagaagcagcugcgcgagaacgccgaggacaugggcaacgggugcuucaagaucuaccacaagugcgacaacgcgugcaucggcucgauccggaacgggacguacgaccacgacguguaccgcgacgaggcccucaacaaccgguuccagaucaagggcguggagcugaaguccggcuacaaggacuggauccuguggaucagcuucgccaucuccugcuuccuccugugcgucgcccugcucggguucaucaugugggccugccagaagggcaacauccgcugcaacaucugcaucuga

SEQ ID NO: 2877 - RNA, 1701 nt, Artificial Sequence
  derived and/or modified CDS sequence (AUadapt) from InfluenzaA__ACO95153__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucaacuggaccggcgugacccagaacgggaccuccagcgccugcaagcgccgguccaacaacucguucuucucccgccugaacuggcucacgcaccugaaguucaaguaccccgcccugaacgugaccaugcccaacaacgagaacuucgacaagcucuacaucuggggcguccaccaccccgggaccgacaacgaccagaucagccuguacgcgcaggccuccggccggaucaccgugucgacgaagcgcucgcagcagaccgugaucccgaacaucggcucccggccccgcguccgggacaucagcucccgcaucucgaucuacuggaccaucgugaagcccggggacauccugcucaucaacuccaccggcaaccugaucgcgccccggggguacuucaagauccgcucgggcaaguccagcaucaugcgguccgacgccccgaucggcaagugcaacucggagugcaucacgcccaacggguccauccccaacgacaagcccuuccagaacgugaaccgcaucaccuacggcgccugcccgcgguacgucaagcagaacacccugaagcucgccaccgggaugcgcaacgugcccgagacgcagacccggggcaucuucggggccaucgccggcuucaucgagaacggcugggaggggaugguggacggcugguacggguuccgccaccagaacucggagggcaccgggcaggccgccgaccugaaguccacccaggcggccaucaaccagaucaacggcaagcugaaccggcucaucggcaagacgaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacaccaucgaccucaccgacucggagaugaacaagcuguucgagcggacgaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 2878 - RNA, 1701 nt, Artificial Sequence; identical to SEQ ID NO: 2843
  derived and/or modified CDS sequence (AUadapt) from InfluenzaA__ACO95171__HA

SEQ ID NO: 2879 - RNA, 1701 nt, Artificial Sequence
  derived and/or modified CDS sequence (AUadapt) from InfluenzaA__ACO95193__HA
augaagaccaucaucgcccugucguacauccucugccugguguucgcccagaagcugcccggcaacgacaaguccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagaacuucaacuggaccggcgugacccagaacgggaccucguccgccugcaagcgccggagcaacaacuccuucuucucgcgccugaacuggcucacgcaccugaaguucaaguaccccgcccugaacgugaccaugcccaacaacgagaaguucgacaagcucuacaucuggggcguccaccaccccgggaccgacaacgaccagaucucccuguacgcgcaggccagcggccggaucaccguguccacgaagcgcucgcagcagaccgugaucccgaacaucggcucgcggccccgcguccgggacaucuccagccgcaucuccaucuacuggaccaucgugaagcccggggacauccugcucaucaacucgaccggcaaccugaucgcgccccggggguacuucaagauccgcuccggcaagucguccaucaugcggagcgacgccccgaucggcaagugcuccucggagugcaucacgcccaacggguccauccccaacgacaagcccuuccagaacgugaaccgcaucaccuacggcgccugcccgcgguacgucaagcagaacacccugaagcucgccaccgggaugcgcaacgugcccgagacgcagacccggggcaucuucggggccaucgccggcuucaucgagaacggcugggaggggaugguggacggcugguacggguuccgccaccagaacucggagggcaccgggcaggccgccgaccugaaguccacccaggcggccaucaaccagaucaacggcaagcugaaccggcucaucggcaagacgaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacaccaucgaccucaccgacucggagaugaacaagcuguucgagcggacgaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 2880 - RNA, 1701 nt, Artificial Sequence; identical to SEQ ID NO: 2842
  derived and/or modified CDS sequence (AUadapt) from InfluenzaA__ACO95204__HA

SEQ ID NO: 2881 - RNA, 1701 nt, Artificial Sequence
  derived and/or modified CDS sequence (AUadapt) from InfluenzaA__ACO95215__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcuccaaggccuacuccaacugcuaccccuacgacgugccggacuacgcgucgcugcggucccucaucgccagcuccgggacgcuggaguucaacaacgagucguucaacuggaccggcgucacccagaacgggaccuccagcgccugcaagcgccgguccaacaacucguucuucucccgccugaacuggcucacgcaccugaaguucaaguaccccgcccugaacgugaccaugcccaacaacgagaaguucgacaagcucuacaucuggggcgugcaccaccccgggaccgacaacgaccagaucucgcuguacgcgcaggccuccggccggaucaccgucagcacgaagcgcucgcagcagaccgugaucccgaacaucggcucccggccccgcgugcgggacaucagcucccgcaucucgaucuacuggaccaucgucaagcccggggacauccugcucaucaacuccaccggcaaccugaucgcgccccggggguacuucaagauccgcucgggcaaguccagcaucaugcgguccgacgccccgaucggcaagugcaacucggagugcaucacgcccaacggguccauccccaacgacaagcccuuccagaacgugaaccgcaucaccuacggcgccugcccgcgguacgugaagcagaacacccugaagcucgccaccgggaugcgcaacguccccgagacgcagacccggggcaucuucggggccaucgccggcuucaucgagaacggcugggaggggaugguggacggcugguacggguuccgccaccagaacagcgagggcaccgggcaggccgccgaccugaaguccacccaggcggccaucaaccagaucaacggcaagcugaaccggcucaucggcaagacgaacgagaaguuccaccagaucgagaaggaguucucggagguggaggggcgcauccaggaccuggagaaguacgucgaggacaccaagaucgaccugugguccuacaacgccgagcuccugguggcccuggagaaccagcacaccaucgaccucaccgacucggagaugaacaagcuguucgagcggacgaagaagcagcugcgcgagaacgccgaggacaugggcaacgggugcuucaagaucuaccacaagugcgacaacgcgugcaucggcuccauccgcaacgagaccuacgaccacgacguguaccgggacgaggcccucaacaaccgcuuccagaucaagagcgucgagcugaaguccggguacaaggacuggauccuguggaucucguucgccaucagcugcuuccuccugugcguggcccugcucggcuucaucaugugggccugccagaagggcaacauccggugcaacaucugcaucuga

SEQ ID NO: 2882 - RNA, 1701 nt, Artificial Sequence; identical to SEQ ID NO: 526
  derived and/or modified CDS sequence (AUadapt) from InfluenzaA__ACO95226__HA

SEQ ID NO: 2883 - RNA, 1701 nt, Artificial Sequence; identical to SEQ ID NO: 875
  derived and/or modified CDS sequence (AUadapt) from InfluenzaA__ACO95248__HA

SEQ ID NO: 2884 - RNA, 1701 nt, Artificial Sequence
  derived and/or modified CDS sequence (AUadapt) from InfluenzaA__ACO95270__HA
augaagaccaucaucgcccugucguacauccucugccugguguucacccagaagcugcccggcaacgacaacuccacggccacccucugccuggggcaccacgcggucccgaacggcaccaucgugaagaccaucacgaacgaccagaucgaggugaccaacgccaccgagcugguccagagcuccucgaccggggagaucugcgacagcccccaccagauccucgacggcgagaacugcacgcugaucgacgcccugcucggggacccccagugcgacggcuuccagaacaagaagugggaccuguucguggagcgcucgaaggccuacuccaacugcuaccccuacgacgugccggacuacgccagccugcggucccucgucgcgucguccggcacccuggaguucaacaacgagagcuucaacuggaccggggugacccagaacggcacguccucggccugcauccgccgguccaacaacagcuucuucucccgccugaacuggcucacccaccugaaguucaaguaccccgcccugaacgugaccaugcccaacaacgagaaguucgacaagcucuacaucuggggcguccaccaccccgugaccgacaacaaccagaucuuccuguacgcccaggcgucggggcggaucacgguguccaccaagcgcagccagcagaccgucaucccgaacaucgggucgcggccccgcgugcggaacauccccucccgcaucagcaucuacuggaccaucgugaagcccggcgacauccugcucaucaacuccacgggcaaccugaucgccccgcggggguacuucaagauccgcucgggcaaguccagcaucaugcgguccgacgcccccaucgggaagugcaacucggagugcaucacccccaacggcuccauccccaacgacaagccguuccagaacgucaaccgcaucaccuacggcgccugcccccgguacgugaagcagaacacccugaagcucgccacggggaugcgcaacgugcccgagaagcagacccggggcaucuucggggcgaucgccggcuucaucgagaacgggugggagggcauggucgacggcugguacggguuccgccaccagaacagcgagggcaucgggcaggccgccgaccugaaguccacccaggccgcgaucgaccagaucaacggcaagcugaaccggcucaucgggaagaccaacgagaaguuccaccagaucgagaaggaguucucggagguggagggccgcauccaggaccuggagaaguacguggaggacacgaagaucgaccugugguccuacaacgccgagcuccuggucgcccuggagaaccagcacaccaucgaccucaccgacagcgagaugaacaagcuguucgagaagaccaagaagcagcugcgggagaacgccgaggacaugggcaacgggugcuucaagaucuaccacaagugcgacaacgccugcaucggcuccauccgcaacgggacguacgaccacgacguguaccgcgacgaggcgcucaacaaccgguuccagaucaagggcguggagcugaaguccggguacaaggacuggauccuguggaucuccuucgccaucagcugcuuccuccugugcgucgcccugcucggcuucaucaugugggccugccagaagggcaacauccgcugcaacaucugcaucuga

SEQ ID NO: 2885 - RNA, 1701 nt, Artificial Sequence; identical to SEQ ID NO: 2679
  derived and/or modified CDS sequence (AUadapt) from InfluenzaA__ACO95281__HA

SEQ ID NO: 2886 - RNA, 1701 nt, Artificial Sequence
  derived and/or modified CDS sequence (AUadapt) from InfluenzaA__ACO95292__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccucggggcggaucaccguguccacgaagcgcagccagcagaccgugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccagucggggaaguccucgaucaugcgcuccgacgcccccaucggcaagugcaacagcgagugcaucacgcccaacggcuccauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggguucaucgagaacggcugggagggcaugguggacgggugguacggcuuccggcaccagaacucggaggggcgcggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 2887 - RNA, 1701 nt, Artificial Sequence; identical to SEQ ID NO: 2782
  derived and/or modified CDS sequence (AUadapt) from InfluenzaA__ACO95303__HA

SEQ ID NO: 2888 - RNA, 1698 nt, Artificial Sequence
  derived and/or modified CDS sequence (AUadapt) from InfluenzaA__ACO95382__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggagggguccuggcccaaccacacggucaccggcgugucggccuccugcagccacaacggggaguccagcuucuaccgcaaccugcuguggcucaccggcaagaacgggcuguaccccaaccuguccaagucguacgccaacaacaaggagaaggaggugcucguccuguggggcgugcaccacccgcccaacaucggcgaccagaaggcccuguaccacaccgagaacgccuacguguccgucgugagcagccacuacucccggaaguucacgcccgagaucgccaagcgccccaaggugcgggaccaggaggggcgcaucaacuacuacuggacccuccuggagcccggcgacaccaucaucuucgaggcgaacgggaaccugaucgccccgcgguacgccuucgcccucucgcgcggcuucggcuccgggaucaucaacagcaacgcccccauggacaagugcgacgcgaagugccagacgccccagggcgccaucaacuccagccugcccuuccagaacguccacccggugaccaucggggagugccccaaguacgugcgguccgccaagcugcgcauggucaccggccuccggaacauccccucgauccagucccgcgggcuguucggcgccaucgccggcuucaucgagggcggcuggaccgggaugguggacggcugguacggguaccaccaccagaacgagcagggcagcggcuacgcggccgaccagaaguccacccagaacgccaucaacgggaucacgaacaaggugaacagcgucaucgagaagaugaacacccaguucaccgccgugggcaaggaguucaacaagcuggagcggcgcauggagaaccucaacaagaaggucgacgacggguucaucgacaucuggaccuacaacgccgagcugcuggugcuccuggagaacgagcggacgcuggacuuccacgacuccaacgugaagaaccucuacgagaaggucaagucgcagcugaagaacaacgcgaaggagaucggcaacgggugcuucgaguucuaccacaagugcaacgacgagugcauggaguccgugaagaacggcaccuacgacuaccccaaguacagcgaggaguccaagcugaaccgcgagaagaucgacggcgugaagcucgagagcaugggggucuaccagauccuggccaucuacuccaccguggccucgagccuggugcuccuggucucccugggcgccaucagcuucuggaugugcuccaacgggagccuccagugccggaucugcaucuga

SEQ ID NO: 2889 - RNA, 1698 nt, Artificial Sequence
  derived and/or modified CDS sequence (AUadapt) from InfluenzaA__ACO95415__HA
augaaggugaagcugcucguccugcugugcaccuucaccgccacguacgccgacaccaucugcaucggcuaccacgcgaacaacucgaccgacaccaucgacacggugcucgagaagaacgugaccgucacccacuccgugaaccugcuggagaacagccacaacgggaagcucugccugcugaagggcaucgcgccccuccagcuggggaacugcuccguggccggcuggauccuggggaacccggagugcgagcuccugaucagcaaggaguccuggucguacaucgucgagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggugaccggggucuccgccucgugcucccacaacggcgagagcuccuucuaccgcaaccugcuguggcucaccgggaagaacggccuguaccccaaccugagcaaguccuacgccaacaacaaggggaaggaggugcucgugcuguggggcguccaccacccgcccaacaucggcgaccagaacacccuguaccacacggagaacgccuacgugucgguggucagcucccacuacagccggaaguucacccccgagaucgccaagcgccccaaggugcgggaccaggaggggcgcaucaacuacuacuggacccuccuggagcccggcgacaccaucaucuucgaggccaacgggaaccugaucgcgccgcgguacgccuucgcccucucccgcggcuucggcagcgggaucaucaacuccaacgcccccauggacaagugcgacgccaagugccagacgccccagggcgcgaucaacucgucccugcccuuccagaacgugcacccggucaccaucggggagugccccaaguacgugcggagcgccaagcugcgcauggugaccggccuccggaacauccccuccauccagagccgcgggcuguucggcgccaucgccggcuucaucgagggcggcuggaccgggauggucgacggcugguacggguaccaccaccagaacgagcagggcuccggcuacgccgcggaccagaaguccacgcagaacgccaucaacgggaucaccaacaaggugaacucggugaucgagaagaugaacacccaguucaccgccgucggcaaggaguucaacaagcuggagcggcgcauggagaaccucaacaagaagguggacgacggguucaucgacaucuggacguacaacgccgagcugcugguccuccuggagaacgagcggacccuggacuuccacgacagcaacgugaagaaccucuacgagaaggugaagucccagcugaagaacaacgccaaggagaucggcaacgggugcuucgaguucuaccacaagugcaacgacgagugcauggagagcgucaagaacggcaccuacgacuaccccaaguacuccgaggagagcaagcugaaccgcgagaagaucgacggcgugaagcucgaguccauggggguguaccagauccuggcgaucuacucgaccgucgccagcucccuggugcuccuggugagccugggcgccaucuccuucuggaugugcagcaacgggucccuccagugccggaucugcaucuga

SEQ ID NO: 2890 - RNA, 1701 nt, Artificial Sequence
  derived and/or modified CDS sequence (AUadapt) from InfluenzaA__ACO95426__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagagcuucgacuggaccggcgugacccagaacgggaccuccucguccugcaagcgccggucgaacaacuccuucuucagccgccugaacuggcucacgcaccugaaguacaaguaccccgcccugaacgugaccaugcccaacaacgagaaguucgacaagcucuacaucuggggcguccaccaccccgggaccgacuccgaccagaucucgcuguacgcccaggcgagcggccggaucaccguguccacgaagcgcucgcagcagaccgugaucccgaacaucggcucccggccccgcguccgggacgugucgucccgcaucagcaucuacuggaccaucgugaagcccggggacauccugcucaucaacuccaccggcaaccugaucgcgccccggggguacuucaagauccgcucgggcaaguccagcaucaugcgguccgacgccccgaucggcaagugcaacucggagugcaucacgcccaacggguccauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacucggagggcaccgggcaggccgccgaccugaaguccacccaggccgcgaucaaccagaucaacggcaagcugaaccggcucaucggcaagaccaacgagaaguuccaccagaucgagaaggaguucagcgagguggaggggcgcauccaggaccuggagaaguacguggaggacacgaagaucgaccugugguccuacaacgccgagcuccuggucgcccuggagaaccagcacaccaucgaccucaccgacucggagaugaacaagcuguucgagcggaccaagaagcagcugcgcgagaacgccgaggacaugggcaacgggugcuucaagaucuaccacaagugcgacaacgccugcaucggcuccauccgcaacgggacguacgaccacgacguguaccgggacgaggcgcucaacaaccgcuuccagaucaagggcguggagcugaaguccggcuacaaggacuggauccuguggaucagcuucgccaucuccugcuuccuccugugcgucgcccugcucggguucaucaugugggccugccagaagggcaacauccggugcaacaucugcaucuga

SEQ ID NO: 2891 - RNA, 1701 nt, Artificial Sequence; identical to SEQ ID NO: 2040
  derived and/or modified CDS sequence (AUadapt) from InfluenzaA__ACO95437__HA

SEQ ID NO: 2892 - RNA, 1701 nt, Artificial Sequence
  derived and/or modified CDS sequence (AUadapt) from InfluenzaA__ACO95448__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucaucgccucguccgggacgcuggaguucaacaacgagucguucaacuggaccggcgucacccagaacgggaccuccagcgccugcaagcgccgguccaacaacucguucuucucccgccugaacuggcucacgcaccugaaguucaaguaccccgcccugaacgugaccaugcccaacaacgaggaguucgacaagcucuacaucuggggcgugcaccaccccgggaccgacaacgaccagaucaaccuguacgcgcaggccucgggccggaucaccgucuccacgaagcgcagccagcagaccgugaucccgaacaucggcucgcggccccgcgugcgggacauccccucccgcaucucgaucuacuggaccaucgucaagcccggggacauccugcucaucaacuccaccggcaaccugaucgccccgcggggguacuucaagauccgcagcggcaaguccucgaucaugcgguccgacgcccccaucggcaagugcaacucggagugcaucacgcccaacggguccauccccaacgacaagccguuccagaacgugaaccgcaucaccuacggcgccugcccccgguacgugaagcagaacacccugaagcucgcgaccgggaugcgcaacguccccgagaagcagacgcggggcaucuucggggccaucgccggcuucaucgagaacggcugggaggggaugguggacggcugguacggguuccgccaccagaacagcgagggcaucgggcaggccgccgaccugaaguccacccaggcggccaucgaccagaucaacggcaagcugaaccggcucaucggcaagaccaacgagaaguuccaccagaucgagaaggaguucucggagguggaggggcgcauccaggaccuggagaaguacgucgaggacaccaagaucgaccugugguccuacaacgccgagcuccugguggcccuggagaaccagcacacgaucgaccucaccgacucggagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacguguaccgggacgaggcccucaacaaccgcuuccagaucaagggcgucgagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 2893 - RNA, 1701 nt, Artificial Sequence; identical to SEQ ID NO: 875
  derived and/or modified CDS sequence (AUadapt) from InfluenzaA__ACO95459__HA

SEQ ID NO: 2894 - RNA, 1701 nt, Artificial Sequence
  derived and/or modified CDS sequence (AUadapt) from InfluenzaA__ACO95470__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucgucgccagcuccgggacgcuggaguucaacaacgagucguucaacuggaccggcgugacccagaacgggaccuccucggccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccucgggccggaucaccguguccacgaagcgcagccagcagaccgugaucccgaacaucggcucgcggccccgcguccggaacauccccucccgcaucagcaucuacuggaccaucgugaagcccggggacauccugcucaucaacuccaccggcaaccugaucgccccgcggggguacuucaagauccgcucgggcaaguccucgaucaugcgguccgacgcccccaucggccgcugcaacagcgagugcaucacgcccaacggguccauccccaacgacaagccguuccagaacgugaaccggaucaccuacggcgccugcccccgcuacgucaagcagaacacccugaagcucgcgaccgggaugcggaacgugcccgagaagcagacgcgcggcaucuucggggccaucgccggcuucaucgagaacggcugggaggggaugguggacggcugguacggguuccggcaccagaacucggagggcaucgggcaggccgccgaccugaaguccacccaggcggccaucaaccagaucaacggcaagcugaaccgccucaucggcaagaccaacgagaaguuccaccagaucgagaaggaguucagcgaggucgaggggcggauccaggaccuggagaaguacguggaggacaccaagaucgaccugugguccuacaacgccgagcuccugguggcccuggagaaccagcacacgaucgaccucaccgacucggagaugaacaagcuguucgagcgcaccaagaagcagcugcgcgagaacgccgaggacaugggcaacgggugcuucaagaucuaccacaagugcgacaacgcgugcaucggcuccauccggaacgggaccuacgaccacgacgucuaccgcgacgaggcccucaacaaccgguuccagaucaagggcguggagcugaaguccggcuacaaggacuggauccuguggaucuccuucgccaucagcugcuuccuccugugcguggcccugcucggguucaucaugugggccugccagaagggcaacauccgcugcaacaucugcaucuga

SEQ ID NO: 2895 - RNA, 1701 nt, Artificial Sequence
  derived and/or modified CDS sequence (AUadapt) from InfluenzaA__ACO95481__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucgucgccagcuccgggacgcuggaguucaacaacgagucguucaacuggaccggcgugacccagaacgggaccuccucggccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccucgggccggaucaccguguccacgaagcgcagccagcagaccgugaucccgaacaucggcucgcggccccgcguccggaacauccccucccgcaucagcaucuacuggaccaucgugaagcccggggacauccugcucaucaacuccaccggcaaccugaucgccccgcggggguacuucaagauccgcucgggcaaguccucgaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccugaagcucgcgaccgggaugcgcaaccugcccgagaagcagacgcggggcaucuucggggccaucgccggcuucaucgagaacggcugggaggggaugguggacggcugguacggguuccgccaccagaacucggagggcaucgggcaggccgccgaccugaaguccacccaggcggccaucaaccagaucaacggcaagcucaaccggcugaucggcaagaccaacgagaaguuccaccagaucgagaaggaguucagcgagguggaggggcgcauccaggaccuggagaaguacgucgaggacaccaagaucgaccucugguccuacaacgccgagcugcugguggcccucgagaaccagcacacgaucgaccugaccgacucggagaugaacaagcuguucgagcggaccaagaagcagcuccgcgagaacgccgaggacaugggcaacgggugcuucaagaucuaccacaagugcgacaacgcgugcaucggcuccauccgcaacgggaccuacgaccacgacguguaccgggacgaggcccugaacaaccgcuuccagaucaagggcgucgagcugaaguccggcuacaaggacuggauccucuggaucuccuucgccaucagcugcuuccugcugugcguggcccuccugggguucaucaugugggccugccagaagggcaacauccggugcaacaucugcaucuga

SEQ ID NO: 2896 - RNA, 1701 nt, Artificial Sequence; identical to SEQ ID NO: 875
  derived and/or modified CDS sequence (AUadapt) from InfluenzaA__ACO95492__HA

SEQ ID NO: 2897 - RNA, 1701 nt, Artificial Sequence; identical to SEQ ID NO: 875
  derived and/or modified CDS sequence (AUadapt) from InfluenzaA__ACO95503__HA

SEQ ID NO: 2898 - RNA, 1701 nt, Artificial Sequence; identical to SEQ ID NO: 875
  derived and/or modified CDS sequence (AUadapt) from InfluenzaA__ACO95514__HA

SEQ ID NO: 2899 - RNA, 1701 nt, Artificial Sequence; identical to SEQ ID NO: 875
  derived and/or modified CDS sequence (AUadapt) from InfluenzaA__ACO95536__HA

SEQ ID NO: 2900 - RNA, 1701 nt, Artificial Sequence; identical to SEQ ID NO: 875
  derived and/or modified CDS sequence (AUadapt) from InfluenzaA__ACO95547__HA

SEQ ID NO: 2901 - RNA, 1701 nt, Artificial Sequence; identical to SEQ ID NO: 62
  derived and/or modified CDS sequence (AUadapt) from InfluenzaA__ACP41963__HA

SEQ ID NO: 2902 - RNA, 1698 nt, Artificial Sequence; identical to SEQ ID NO: 2888
  derived and/or modified CDS sequence (AUadapt) from InfluenzaA__ACP44192__HA

SEQ ID NO: 2903 - RNA, 1698 nt, Artificial Sequence; identical to SEQ ID NO: 2888
  derived and/or modified CDS sequence (AUadapt) from InfluenzaA__ACP44203__HA

SEQ ID NO: 2904 - RNA, 1698 nt, Artificial Sequence
  derived and/or modified CDS sequence (AUadapt) from InfluenzaA__ACP44225__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcggccuccugaucagcaaggaguccuggucguacaucguggagaagcccaaccccgagaacgggaccugcuaccccgggcacuucgccgacuacgaggagcugcgcgagcagcucuccagcguguccagcuucgagcgguucgagaucuucccgaaggaguccagcuggcccaaccacacggucaccggcguguccgccucgugcucccacaacggggagagcuccuucuaccgcaaccugcuguggcucaccggcaagaacgggcuguaccccaaccugagcaaguccuacgccaacaacaaggagaaggaggugcucguccuguggggcgugcaccacccgcccaacaucggcgaccagaaggcccuguaccacaccgagaacgccuacgugucggucgugagcucccacuacagccggaaguucacgcccgagaucgccaagcgccccaaggugcgggaccaggaggggcgcaucaacuacuacuggacccuccuggagcccggcgacaccaucaucuucgaggcgaacgggaaccugaucgccccgcgguacgccuucgcccucucccgcggcuucggcagcgggaucaucaacuccaacgcccccauggacaagugcgacgcgaagugccagacgccccagggcgccaucaacucgucccugcccuuccagaacguccacccggugaccaucggggagugccccaaguacgugcggagcgccaagcugcgcauggucaccggccuccggaacauccccuccauccagagccgcgggcuguucggcgccaucgccggcuucaucgagggcggcuggaccgggaugguggacggcugguacggguaccaccaccagaacgagcagggcuccggcuacgcggccgaccagaaguccacccagaacgccaucaacgggaucacgaacaaggugaacucggucaucgagaagaugaacacccaguucaccgccgugggcaaggaguucaacaagcuggagcggcgcauggagaaccucaacaagaaggucgacgacggguucaucgacaucuggaccuacaacgccgagcugcuggugcuccuggagaacgagcggacgcuggacuuccacgacagcaacgugaagaaccucuacgagaaggucaagucccagcugaagaacaacgcgaaggagaucggcaacgggugcuucgaguucuaccacaagugcaacgacgagugcauggagagcgugaagaacggcaccuacgacuaccccaaguacuccaaggagagcaagcugaaccgcgagaagaucgacggcgugaagcucgaguccaugggggucuaccagauccuggccaucuacucgaccguggccagcucccuggugcuccuggucagccugggcgccaucuccuucuggaugugcagcaacgggucccuccagugccggaucugcaucuga

SEQ ID NO: 2905 - RNA, 1701 nt, Artificial Sequence
  derived and/or modified CDS sequence (AUadapt) from InfluenzaA__ACP44236__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucaacuggaccggcgugacccagaacgggaccuccagcgccugcaagcgccgguccgacaagucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucucgcuguacgcgcaggccuccggccggaucaccgugagcacgaagcgcucgcagcagaccgugaucccgaacaucggcucccggccccgcguccgggacgugcccucgcgcaucuccaucuacuggaccaucgugaagcccggggacauccugcucaucaacagcaccggcaaccugaucgccccgcggggguacuucaagauccgcuccggcaagucguccaucaugcggucggacgcccccaucggcaagugcaacuccgagugcaucacgcccaacgggagcauccccaacgacaagccguuccagaacgucaaccgcaucaccuacggcgccugcccccgguacgugaagcagaacacccugaagcucgcgaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacguggaggacacgaagaucgaccuguggucguacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcucgauccgcaacgggacguacgaccacgacguguaccgggacgaggcccucaacaaccgcuuccagaucaagggcguggagcugaaguccggcuacaaggacuggauccuguggaucagcuucgccaucuccugcuuccuccugugcgucgcccugcucggguucaucaugugggccugccagaagggcaacauccggugcaacaucugcaucuga

SEQ ID NO: 2906 - RNA, 1701 nt, Artificial Sequence; identical to SEQ ID NO: 2842
  derived and/or modified CDS sequence (AUadapt) from InfluenzaA__ACP44247__HA

SEQ ID NO: 2907 - RNA, 1701 nt, Artificial Sequence; identical to SEQ ID NO: 875
  derived and/or modified CDS sequence (AUadapt) from InfluenzaA__ACP44258__HA

SEQ ID NO: 2908 - RNA, 1701 nt, Artificial Sequence; identical to SEQ ID NO: 875
  derived and/or modified CDS sequence (AUadapt) from InfluenzaA__ACP44269__HA

SEQ ID NO: 2909 - RNA, 1701 nt, Artificial Sequence; identical to SEQ ID NO: 62
  derived and/or modified CDS sequence (AUadapt) from InfluenzaA__ACQ44554__HA

SEQ ID NO: 2910 - RNA, 1701 nt, Artificial Sequence; identical to SEQ ID NO: 62
  derived and/or modified CDS sequence (AUadapt) from InfluenzaA__ACQ44556__HA

SEQ ID NO: 2911 - RNA, 1701 nt, Artificial Sequence; identical to SEQ ID NO: 62
  derived and/or modified CDS sequence (AUadapt) from InfluenzaA__ACQ45338__HA

SEQ ID NO: 2912 - RNA, 1701 nt, Artificial Sequence; identical to SEQ ID NO: 53
  derived and/or modified CDS sequence (AUadapt) from InfluenzaA__ACQ55359__HA

SEQ ID NO: 2913 - RNA, 1701 nt, Artificial Sequence; identical to SEQ ID NO: 62
  derived and/or modified CDS sequence (AUadapt) from InfluenzaA__ACQ55361__HA

SEQ ID NO: 2914 - RNA, 1701 nt, Artificial Sequence; identical to SEQ ID NO: 116
  derived and/or modified CDS sequence (AUadapt) from InfluenzaA__ACQ63223__HA

SEQ ID NO: 2915 - RNA, 1701 nt, Artificial Sequence; identical to SEQ ID NO: 116
  derived and/or modified CDS sequence (AUadapt) from InfluenzaA__ACQ63239__HA

SEQ ID NO: 2916 - RNA, 1701 nt, Artificial Sequence; identical to SEQ ID NO: 116
  derived and/or modified CDS sequence (AUadapt) from InfluenzaA__ACQ63244__HA

SEQ ID NO: 2917 - RNA, 1701 nt, Artificial Sequence; identical to SEQ ID NO: 116
  derived and/or modified CDS sequence (AUadapt) from InfluenzaA__ACQ63257__HA

SEQ ID NO: 2918 - RNA, 1701 nt, Artificial Sequence
  derived and/or modified CDS sequence (AUadapt) from InfluenzaA__ACQ65691__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcuccaaggccuacuccaacugcuaccccuacgacgugccggacuacgcgagccugcggucccucgucgccucguccgggacgcuggaguucaacaacgagagcuucaacuggaccggcgugacccagaacgggaccuccucguccugcaagcgcggcucggacaacuccuucuucagccggcugaacuggcucacgcaccugaaguucaaguaccccgcccugaacgugaccaugcccaacaacgagaaguucgacaagcucuacaucuggggcguccaccaccccgggaccgacaacgaccagaucuucccguacgcccaggcguccggccgcaucaccgugucgacgaagcggagccagcagaccgugauccccaacaucgggucccgcccccggguccgcgacauccccucgcggaucuccaucuacuggaccaucgugaagccgggcgacauccugcugaucaacagcaccgggaaccucaucgcgccccgcggcuacuucaagauccgguccggcaagucguccaucaugcgcucggacgcccccaucgggaagugcaacuccgagugcaucacgcccaacggcagcaucccgaacgacaagcccuuccagaacgugaaccggaucaccuacggggccugcccccgcuacgucaagcagaacacccugaagcuggccaccggcaugcggaacgugcccgagaagcagacgcgcgggaucuucggcgccaucgccggcuucaucgagaacgggugggagggcaugguggacgggugguacggcuuccggcaccagaacuccgaggggaucggccaggccgccgaccucaagucgacccaggccgcgaucaaccagaucaacggcaagcugaaccgccugaucgggaagaccaacgagaaguuccaccagaucgagaaggaguucuccgaggucgagggccggauccaggaccucgagaaguacguggaggacaccaagaucgaccuguggagcuacaacgccgagcugcucguggcccuggagaaccagcacacgaucgaccugaccgacuccgagaugaacaagcuguucgagcgcaccaagaagcagcuccgggagaacgccgaggacauggggaacggcugcuucaagaucuaccacaagugcgacaacgccugcaucgggucgauccgcaacggcaccuacgaccacgacgucuaccgcgacgaggcgcugaacaaccgguuccagaucaagggcguggagcucaaguccggguacaaggacuggauccuguggaucagcuucacgaucuccugcuuccugcucugcguggcccugcugggcuucaucaugugggccugccagaaggggaacauccgcugcaacaucugcaucuga

SEQ ID NO: 2919 - RNA, 1701 nt, Artificial Sequence; identical to SEQ ID NO: 2679
  derived and/or modified CDS sequence (AUadapt) from InfluenzaA__ACQ65713__HA

SEQ ID NO: 2920 - RNA, 1701 nt, Artificial Sequence
  derived and/or modified CDS sequence (AUadapt) from InfluenzaA__ACQ65724__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacugggccggggugacccagaacggcaccuccucggccugcauccgccgguccaacaacagcuucuucucccgccugaacuggcucacccaccugaaguucaaguaccccgcgcugaacgugacgaugcccaacaacgagcaguucgacaagcucuacaucuggggcguccaccaccccgggaccgacaacgaccagaucuuccuguacgcccaggccucggggcggaucaccguguccaccaagcgcagccagcagacggugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccucgaucaugcgguccgacgcccccaucggcaagugcaacagcgagugcaucacccccaacggcuccauccccaacgacaagccguuccagaacgugaaccgcaucacguacggggcgugcccccgguacgucaagcagaacacccugaagcucgccaccggcaugcgcaacgugcccgagaagcagacccgggggaucuucggcgccaucgccggguucaucgagaacggcugggagggcaugguggacgggugguacggcuuccgccaccagaacucggaggggcggggccaggccgcggaccugaaguccacgcaggccgccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacaccaucgaccucacggacucggagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggcgugccagaaggggaacauccggugcaacaucugcaucuga

SEQ ID NO: 2921 - RNA, 1701 nt, Artificial Sequence
  derived and/or modified CDS sequence (AUadapt) from InfluenzaA__ACQ65747__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccggacgaacaacuccuucuucucgcgccugaacuggcucacccaccugaaguucaaguaccccgcccugaacgugaccaugcccaacaacgagaaguucgacaagcucuacaucuggggcguccaccaccccgggaccgacaacgaccagaucuuccuguacgcgcaggccuccgggcggaucacggugucgaccaagcgcucccagcagaccgugaucccgaacaucggcagccggccccgcguccggaacauccccucgcgcaucuccaucuacuggaccaucgugaagcccggcgacauccugcucaucaacagcacggggaaccugaucgccccgcggggcuacuucaagauccgcuccgggaaguccuccaucaugcggucggacgcccccaucggcaagugcaacuccgagugcaucacccccaacggcagcauccccaacgacaagccguuccagaacgugaaccgcaucaccuacggggccugcccccgguacgucaagcagaacacccugaagcucgcgacgggcaugcgcaacgugcccgagaagcagacccgggggaucuucggcgccaucgccggguucaucgagaacggcugggagggcaugauggacgggugguacggcuuccgccaccagaacuccgaggggaucggccaggccgccgaccucaagucgacccaggcggccaucgaccagaucaacgggaagcugaacggccugaucggcaagaccaacgagaaguuccaccagaucgagaaggaguucuccgagguggaggggcggauccaggaccuggagaaguacgucgaggacacgaagaucgaccuguggagcuacaacgccgagcuccugguggcccuggagaaccagcacaccaucgaccucaccgacuccgagaugaacaagcuguucgagaagaccaagaagcagcugcgcgagaacgccgaggacaugggcaacgggugcuucaagaucuaccacaagugcgacaacgcgugcaucggcucgauccggaacgggacguacgaccacgacguguaccgcgacgaggcccucaacaaccgcuuccagaucaagggcgucgagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 2922 - RNA, 1698 nt, Artificial Sequence
  derived and/or modified CDS sequence (AUadapt) from InfluenzaA__ACQ65758__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacgugguggagaagcccaaccccgagaacgggaccugcuaccccggccacuucgccgacuacgaggagcugcgcgagcagcucuccagcgucuccagcuucgagcgguucgagaucuucccgaaggaguccagcuggcccaaccacacggugaccgggguguccgccucgugcucccacaacggcgagagcuccuucuaccgcaaccugcuguggcucaccgggaagaacggccuguaccccaaccugagcaaguccuacgccaacaacaaggggaaggagguccucgugcuguggggcgugcaccacccgcccaacaucggcgaccagaacacccuguaccacacggagaacgccuacgucucgguggugagcucccacuacagccggaaguucacccccgagaucgccaagcgccccaagguccgggaccaggaggggcgcaucaacuacuacuggacccuccuggagcccggcgacaccaucaucuucgaggccaacgggaaccugaucgcgccgcgguacgccuucgcccucucccgcggcuucggcagcgggaucaucaacuccaacgcccccauggacaagugcgacgccaagugccagacgccccagggcgcgaucaacucgucccugcccuuccagaacgugcacccggugaccaucggggagugccccaaguacguccggagcgccaagcugcgcauggugaccggccuccggaacauccccuccauccagagccgcgggcuguucggcgccaucgccggcuucaucgagggcggcuggaccgggaugguggacggcugguacggguaccaccaccagaacgagcagggcuccggcuacgccgcggaccagaaguccacgcagaacgccaucaacgggaucaccaacaaggucaacucggugaucgagaagaugaacacccaguucaccgccgucggcaaggaguucaacaagcuggagcggcgcauggagaaccucaacaagaagguggacgacggguucaucgacaucuggacguacaacgccgagcugcuggugcuccuggagaacgagcggacccuggacuuccacgacagcaacgucaagaaccucuacgagaaggugaagucccagcugaagaacaacgccaaggagaucggcaacgggugcuucgaguucuaccacaagugcaacgacgagugcauggagagcgugaagaacggcaccuacgacuaccccaaguacuccgaggagagcaagcugaaccgcgagaagaucgacggcgucaagcucgaguccauggggguguaccagauccuggcgaucuacucgaccguggccagcucccugguccuccuggugagccugggcgccaucuccuucuggaugugcagcaacgggucccuccagugccggaucugcaucuga

SEQ ID NO: 2923 - RNA, 1701 nt, Artificial Sequence; identical to SEQ ID NO: 62
  derived and/or modified CDS sequence (AUadapt) from InfluenzaA__ACQ73386__HA

SEQ ID NO: 2924 - RNA, 1701 nt, Artificial Sequence; identical to SEQ ID NO: 116
  derived and/or modified CDS sequence (AUadapt) from InfluenzaA__ACQ73387__HA

SEQ ID NO: 2925 - RNA, 1701 nt, Artificial Sequence
  derived and/or modified CDS sequence (AUadapt) from InfluenzaA__ACQ73555__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagagcuucaacuggaccggcgugacccagaacgggaccuccucggccugcaagcgccgguccaacaacucguucuucucccgccugaacuggcucacgcaccugaaguucaaguaccccgcccugaacgugaccaagcccaacaacgagaaguucgacaagcucuacaucuggggcguccaccaccccgggaccgacaacgaccagaucuuccuguacgcgcaggccagcggccggaucaccguguccacgaagcgcucgcagcagaccgugaucccgaacaucggcucgcggccccgcguccggaacauccccucccgcaucagcaucuacuggaccaucgugaagcccggggacauccugcucaucaacuccaccggcaaccugaucgccccgcggggguacuucaagauccgcucgggcaaguccagcaucaugcgguccgacgcccccaucggcaagugcaacucggagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacucggagggcaucgggcaggccgccgaccugaaguccacccaggcggccaucaaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacacgaucgaccucaccgacucggagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 2926 - RNA, 1701 nt, Artificial Sequence; identical to SEQ ID NO: 116
  derived and/or modified CDS sequence (AUadapt) from InfluenzaA__ACQ76294__HA

SEQ ID NO: 2927 - RNA, 1701 nt, Artificial Sequence; identical to SEQ ID NO: 116
  derived and/or modified CDS sequence (AUadapt) from InfluenzaA__ACQ76314__HA

SEQ ID NO: 2928 - RNA, 1701 nt, Artificial Sequence; identical to SEQ ID NO: 116
  derived and/or modified CDS sequence (AUadapt) from InfluenzaA__ACQ76317__HA

SEQ ID NO: 2929 - RNA, 1701 nt, Artificial Sequence; identical to SEQ ID NO: 92
  derived and/or modified CDS sequence (AUadapt) from InfluenzaA__ACQ76318__HA

SEQ ID NO: 2930 - RNA, 1701 nt, Artificial Sequence; identical to SEQ ID NO: 62
  derived and/or modified CDS sequence (AUadapt) from InfluenzaA__ACQ76326__HA

SEQ ID NO: 2931 - RNA, 1701 nt, Artificial Sequence; identical to SEQ ID NO: 62
  derived and/or modified CDS sequence (AUadapt) from InfluenzaA__ACQ76336__HA

SEQ ID NO: 2932 - RNA, 1701 nt, Artificial Sequence; identical to SEQ ID NO: 62
  derived and/or modified CDS sequence (AUadapt) from InfluenzaA__ACQ76347__HA

SEQ ID NO: 2933 - RNA, 1701 nt, Artificial Sequence; identical to SEQ ID NO: 116
  derived and/or modified CDS sequence (AUadapt) from InfluenzaA__ACQ76365__HA

SEQ ID NO: 2934 - RNA, 1701 nt, Artificial Sequence; identical to SEQ ID NO: 116
  derived and/or modified CDS sequence (AUadapt) from InfluenzaA__ACQ76370__HA

SEQ ID NO: 2935 - RNA, 1701 nt, Artificial Sequence; identical to SEQ ID NO: 62
  derived and/or modified CDS sequence (AUadapt) from InfluenzaA__ACQ76376__HA

SEQ ID NO: 2936 - RNA, 1701 nt, Artificial Sequence
  derived and/or modified CDS sequence (AUadapt) from InfluenzaA__ACQ76383__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaaggggaucaccgccgccugcccgcacgccggcgcgaaguccuucuacaagaaccugaucuggcucgucaagaaggggaacagcuaccccaagcuguccaagucguacaucaacgacaagggcaaggaggugcuggugcucugggggauccaccaccccagcaccuccgccgaccagcagucgcuguaccagaacgccgacgccuacgucuucgugggcuccagccgguacuccaagaaguucaagcccgagaucgccauccgcccgaaggugcgggaccaggagggccgcaugaacuacuacuggacgcuggucgagcccggggacaagaucaccuucgaggcgaccggcaaccucguggugccccgguacgccuucgccauggagcgcaacgccgggucgggcaucaucaucuccgacacccccguccacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgugccgucgauccagucccgggggcuguucggcgccaucgccggguucaucgagggcggcuggaccgggauggucgacggcugguacggguaccaccaccagaacgagcagggcagcggguacgccgccgaccucaaguccacgcagaacgcgaucgacgagaucaccaacaaggugaacucggugaucgagaagaugaacacccaguucaccgccgucggcaaggaguucaaccaccuggagaagcgcaucgagaaccugaacaagaagguggacgacggcuuccucgacaucuggacguacaacgccgagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuaccccaaguacucggaggaggccaagcugaaccgggaggagaucgacggcgugaagcucgaguccacccgcaucuaccagauccuggcgaucuacagcaccguggccucgucccugguccucguggugagccugggggccaucuccuucuggaugugcagcaacggcucccugcagugccggaucugcaucuga

SEQ ID NO: 2937 - RNA, 1701 nt, Artificial Sequence; identical to SEQ ID NO: 116
  derived and/or modified CDS sequence (AUadapt) from InfluenzaA__ACQ76389__HA

SEQ ID NO: 2938 - RNA, 1701 nt, Artificial Sequence; identical to SEQ ID NO: 62
  derived and/or modified CDS sequence (AUadapt) from InfluenzaA__ACQ76401__HA

SEQ ID NO: 2939 - RNA, 1701 nt, Artificial Sequence; identical to SEQ ID NO: 116
  derived and/or modified CDS sequence (AUadapt) from InfluenzaA__ACQ76405__HA

SEQ ID NO: 2940 - RNA, 1701 nt, Artificial Sequence
  derived and/or modified CDS sequence (AUadapt) from InfluenzaA__ACQ76408__HA
augaaggccauccugguggucaugcucuacaccuucgccaccgcgaacgccgacacgcugugcaucggcuaccacgccaacaacucgaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagagccuguccaccgccucguccuggagcuacaucguggagaccuccucguccgacaacggcacgugcuaccccggcgacuucaucgacuacgaggagcugcgggagcagcucagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcuggugaagaaggggaacagcuaccccaagcucuccaagucguacaucaacgacaagggcaaggaggugcugguccugugggggauccaccaccccagcaccuccgccgaccagcagucgcucuaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggucgggcaucaucaucuccgacacccccgugcacgacugcaacacgaccugccagaccccgaagggcgccaucaacaccagccuccccuuccagaacauccaccccaucacgaucgggaagugccccaaguacgugaaguccaccaagcugcggcuggcgaccggccuccgcaacgucccgucgauccagucccgggggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacucggucaucgagaagaugaacacccaguucaccgccgugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcuggaguccacccgcaucuaccagauccucgcgaucuacagcaccgucgccucgucccuggugcugguggucagccucggggccaucuccuucuggaugugcagcaacggcucccugcagugccggaucugcaucuga

SEQ ID NO: 2941 - RNA, 1701 nt, Artificial Sequence
  derived and/or modified CDS sequence (AUadapt) from InfluenzaA__ACQ77601__HA
augaagaccaucaucgcccugucguacauccucugccuggccuucgcgcagaagcugcccggcaacgacaacuccaccgccacgcucugccuggggcaccacgccgugccgaacggcacccuggucaagaccaucaccaacgaccagaucgaggugacgaacgccaccgagcucgugcagucguccagcaccgggcgcaucugcgacucgccccaccagauccuggacggcgagaacugcacccugaucgacgcccuccugggggacccccacugcgacggcuuccagaacaaggagugggaccuguucgucgagcgguccaaggcguacuccgacugcuaccccuacgacgugccggacuacgccucgcuccgcucccugguggccagcuccggcacgcuggaguucaacaacgagucguucaacuggaccggggucgcccagaacggcaccuccagcgcgugcaagcggcgcuccaucaagucguucuucucccggcucaacuggcugcaccagcuggagaaccgcuaccccgcccccaacgugaccaugcccaacaacgacaaguucgacaagcucuacaucuggggcgugcaccacccgucgacggacuccgaccagaucagcgucuacgcccaggccucggggcgggugaccguguccaccaagcgcagccagcagaccgucauccccaacaucgggucccggcccugggugcgcggcaucucgucccggaucucgaucuacuggacgaucgugaagcccggcgacauccugcugaucaacuccaccgggaaccucaucgccccgcgcggcuacuucaagauccggagcgggaaguccucgaucaugcgcuccgacgcgcccaucggcaagugcaacagcgagugcaucacccccaacggcuccauccccaacgacaagccguuccagaacgucaaccggaucaccuacggggccugcccccgcuacgugaagcagaacacgcugaagcuggccaccggcaugcggaacgugcccgagaagcagacccgcgggaucuucggcgccaucgccggguucaucgagaacggcugggagggcaugauggacgggugguacggcuuccggcaccagaacucggaggggaccggccaggcggccgaccucaaguccacgcaggccgccaucaaccagaucaacgggaagcugaacaagcugaucgagaagaccaacgagaaguuccaccagaucgagaaggaguucucggaggucgagggccgcauccaggaccucgagaaguacguggaggacaccaagaucgaccugugguccuacaacgccgagcugcucguggcgcuggagaaccagcacaccaucgaccugacggacagcgagaugaacaagcuguucgagcggacccgcaagcagcuccgcgagaacgccgaggacaugggcaacgggugcuucaagaucuaccacaagugcgacaacgccugcaucggcuccauccggaacgggaccuacgaccacgacgucuaccgcgacgaggcccugaacaaccgguuccagaucaagggcguggagcucaagucgggguacaaggacuggauccuguggaucagcuucgccaucuccugcuuccugcucugcgugguccugcugggcuucaucaugugggcgugccagaagggcaacauccgcugcaacaucugcaucuga

SEQ ID NO: 2942 - RNA, 1701 nt, Artificial Sequence
  derived and/or modified CDS sequence (AUadapt) from InfluenzaA__ACQ83310__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccaugagcuccuucgagcgcuucgagaucuuccccaagaccucguccuggcccaaccacgacagcaacaagggggugaccgccgccugcccgcacgccggcgcgaaguccuucuacaagaaccugaucuggcucgucaagaaggggaacucguaccccaagcuguccaagagcuacaucaacgacaagggcaaggaggugcuggugcucugggggauccaccaccccucgaccuccgccgaccagcagagccuguaccagaacgccgacgccuacgucuucgugggcuccucgcgguacuccaagaagcugaagcccgagaucgccauccgcccgaaggugcgggaccaggagggccgcaugaacuacuacuggacgcucgucgagcccggggacaagaucaccuucgaggcgaccggcaaccugguggugccccgguacgccuucgccauggagcgcaacgccgggagcggcaucaucaucuccgacacccccguccacgacugcaacacgaccugccagaccccgaagggcgccaucaacaccucgcugcccuuccagaacauccaccccaucacgaucgggaagugccccaaguacgugaaguccaccaagcuccggcuggcgaccggccugcgcaacgugccgagcauccagucccggggccucuucggggccaucgccggguucaucgagggcggcuggaccgggauggucgacggcugguacggguaccaccaccagaacgagcagggcucgggguacgccgccgaccugaaguccacgcagaacgcgaucgacgagaucaccaacaaggugaacagcgugaucgagaagaugaacacccaguucaccgccgucggcaaggaguucaaccaccuggagaagcgcaucgagaaccucaacaagaagguggacgacggcuuccuggacaucuggacguacaacgccgagcugcucguccugcuggagaacgagcggacccucgacuaccacgacuccaacgugaagaaccuguacgagaaggugcgcucgcagcugaagaacaacgccaaggagaucgggaacggcugcuucgaguucuaccacaagugcgacaacacgugcauggaguccgucaagaacgggaccuacgacuaccccaaguacagcgaggaggccaagcucaaccgggaggagaucgacggcgugaagcuggaguccacccgcaucuaccagauccuggcgaucuacucgaccguggccagcucccucguccugguggugucgcugggggccaucuccuucuggaugugcagcaacggcucccuccagugccggaucugcaucuga

SEQ ID NO: 2943 - RNA, 1701 nt, Artificial Sequence; identical to SEQ ID NO: 62
  derived and/or modified CDS sequence (AUadapt) from InfluenzaA__ACQ84451__HA

SEQ ID NO: 2944 - RNA, 1701 nt, Artificial Sequence; identical to SEQ ID NO: 62
  derived and/or modified CDS sequence (AUadapt) from InfluenzaA__ACQ84457__HA

SEQ ID NO: 2945 - RNA, 1701 nt, Artificial Sequence
  derived and/or modified CDS sequence (AUadapt) from InfluenzaA__ACQ84477__HA
augaaggccauccugcucgugcugcuguacaccuucaccgccgcgaacgccgacacgcucugcaucggcuaccacgccaacaacucgaccgacaccgucgacaccgugcuggagaagaacgugacggucacccacuccgugaaccugcucgaggaccgccacaacgggaagcugugcaagcugcggggcguggcgccccuccaccuggggaagugcaacaucgccggcuggcugcucgggaacccggagugcgagcugcuguucaccgccucguccuggagcuacaucgucgagaccuccaacucggacaacggcacgugcuaccccggcgacuucaucaacuacgaggagcuccgcgagcagcuguccagcguguccucguucgagcgguucgagaucuuccccaaggccuccagcuggcccgaccacgagaccaaccgcggggugaccgccgccugcccguacgcgggcgccaacuccuucuaccggaaccugaucuggcucgucaagaaggggaacucguaccccaagcuguccaagagcuacgugaacaacaaggagaaggaggugcugguccucuggggcauccaccacccgcccaccuccacggaccagcagucgcuguaccagaacgccgacgccuacguguucgugggguccagcaaguacaacaagaaguucaagcccgagaucgccacccgccccaagguccggggccaggcgggccgcaugaacuacuacuggacccugguggagcccggggacaccaucacguucgaggccaccggcaaccucguggucccccgguacgccuucgccaugaagcgcgggucgggcuccggcaucaucaucagcgacaccccggugcacgacugcaacaccacgugccagacccccaagggggccaucaacaccucccugcccuuccagaacauccaccccgugaccaucggcgagugcccgaaguacgucaagucgacgaagcugcggauggcgaccgggcuccgcaacauccccuccauccagagccggggccuguucggggccaucgccggcuucaucgagggcggguggaccggcaugaucgacgggugguacggcuaccaccaccagaacgagcagggguccggcuacgccgccgaccagaaguccacccagaacgcgaucgacggcaucacgaacaaggugaacucggugaucgagaagaugaacacccaguucaccgccgucgggaaggaguucaaccaccuggagaagcgcaucgagaaccucaacaagaagguggacgacggcuuccuggacgucuggaccuacaacgccgagcugcucgugcugcuggagaacgagcggacgcucgacuaccacgacagcaacgugaagaaccuguacgagaagguccgcucccagcugaagaacaacgccaaggagaucgggaacggcugcuucgaguucuaccacaagugcgacgacacgugcauggagucggugaagaacgggaccuacgacuaccccaaguacuccgaggagagcaagcucaaccgggaggagaucgacggcgugaagcuggaguccacccgcaucuaccagauccuggccaucuacucgaccgucgcguccagccucgugcugcuggugucccucggcgccaucucguucuggaugugcagcaacgggucccugcagugccggaucugcaucuga

SEQ ID NO: 2946 - RNA, 1701 nt, Artificial Sequence
  derived and/or modified CDS sequence (AUadapt) from InfluenzaA__ACQ89900__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucguggagaagaugaacacccaguucaccgccgucggcaaggaguucaaccaccuggagaagcgcaucgagaaccugaacaagaagguggacgacggcuuccucgacaucuggacguacaacgccgagcugcuggugcuccuggagaacgagcggacccuggacuaccacgacuccaacgucaagaaccucuacgagaaggugcgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgucaagcucgaguccacccgcaucuaccagauccuggcgaucuacagcaccguggccucgucccuggugcucgucgugagccugggggccaucuccuucuggaugugcagcaacggcucccugcagugccggaucugcaucuga

SEQ ID NO: 2947 - RNA, 1701 nt, Artificial Sequence; identical to SEQ ID NO: 116
  derived and/or modified CDS sequence (AUadapt) from InfluenzaA__ACQ89902__HA

SEQ ID NO: 2948 - RNA, 1701 nt, Artificial Sequence
  derived and/or modified CDS sequence (AUadapt) from InfluenzaA__ACQ89904__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaagggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 2949 - RNA, 1701 nt, Artificial Sequence; identical to SEQ ID NO: 2946
  derived and/or modified CDS sequence (AUadapt) from InfluenzaA__ACQ89905__HA

SEQ ID NO: 2950 - RNA, 1701 nt, Artificial Sequence; identical to SEQ ID NO: 62
  derived and/or modified CDS sequence (AUadapt) from InfluenzaA__ACQ99607__HA

SEQ ID NO: 2951 - RNA, 1701 nt, Artificial Sequence; identical to SEQ ID NO: 62
  derived and/or modified CDS sequence (AUadapt) from InfluenzaA__ACQ99608__HA

SEQ ID NO: 2952 - RNA, 1701 nt, Artificial Sequence; identical to SEQ ID NO: 62
  derived and/or modified CDS sequence (AUadapt) from InfluenzaA__ACQ99609__HA

SEQ ID NO: 2953 - RNA, 1701 nt, Artificial Sequence; identical to SEQ ID NO: 62
  derived and/or modified CDS sequence (AUadapt) from InfluenzaA__ACQ99611__HA

SEQ ID NO: 2954 - RNA, 1701 nt, Artificial Sequence
  derived and/or modified CDS sequence (AUadapt) from InfluenzaA__ACQ99614__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcgcaucgagaaccugaacaagaaggucgacgacggcuuccucgacaucuggacguacaacgccgagcugcugauccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuaccccaaguacucggaggaggccaagcugaaccgggaggagaucgacggcgugaagcucgaguccacccgcaucuaccagauccuggcgaucuacagcaccguggccucgucccugguccucguggugagccugggggccaucuccuucuggaugugcagcaacggcucccugcagugccggaucugcaucuga

SEQ ID NO: 2955 - RNA, 1701 nt, Artificial Sequence; identical to SEQ ID NO: 2954
  derived and/or modified CDS sequence (AUadapt) from InfluenzaA__ACQ99616__HA

SEQ ID NO: 2956 - RNA, 1701 nt, Artificial Sequence; identical to SEQ ID NO: 62
  derived and/or modified CDS sequence (AUadapt) from InfluenzaA__ACQ99617__HA

SEQ ID NO: 2957 - RNA, 1701 nt, Artificial Sequence; identical to SEQ ID NO: 62
  derived and/or modified CDS sequence (AUadapt) from InfluenzaA__ACQ99618__HA

SEQ ID NO: 2958 - RNA, 1701 nt, Artificial Sequence; identical to SEQ ID NO: 62
  derived and/or modified CDS sequence (AUadapt) from InfluenzaA__ACQ99619__HA

SEQ ID NO: 2959 - RNA, 1701 nt, Artificial Sequence; identical to SEQ ID NO: 62
  derived and/or modified CDS sequence (AUadapt) from InfluenzaA__ACQ99620__HA

SEQ ID NO: 2960 - RNA, 1701 nt, Artificial Sequence; identical to SEQ ID NO: 2954
  derived and/or modified CDS sequence (AUadapt) from InfluenzaA__ACQ99621__HA

SEQ ID NO: 2961 - RNA, 1701 nt, Artificial Sequence; identical to SEQ ID NO: 62
  derived and/or modified CDS sequence (AUadapt) from InfluenzaA__ACQ99622__HA

SEQ ID NO: 2962 - RNA, 1701 nt, Artificial Sequence
  derived and/or modified CDS sequence (AUadapt) from InfluenzaA__ACR01014__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcgcauggagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 2963 - RNA, 1701 nt, Artificial Sequence; identical to SEQ ID NO: 116
  derived and/or modified CDS sequence (AUadapt) from InfluenzaA__ACR08419__HA

SEQ ID NO: 2964 - RNA, 1701 nt, Artificial Sequence
  derived and/or modified CDS sequence (AUadapt) from InfluenzaA__ACR08429__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacacgggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggccaucuacuccaccgucgcgucgagccuggugcucguggucucccugggggccaucucguucuggaugugcuccaacggcagccugcagugccggaucugcaucuga

SEQ ID NO: 2965 - RNA, 1701 nt, Artificial Sequence; identical to SEQ ID NO: 116
  derived and/or modified CDS sequence (AUadapt) from InfluenzaA__ACR08439__HA

SEQ ID NO: 2966 - RNA, 1701 nt, Artificial Sequence; identical to SEQ ID NO: 116
  derived and/or modified CDS sequence (AUadapt) from InfluenzaA__ACR08449__HA

SEQ ID NO: 2967 - RNA, 1701 nt, Artificial Sequence
  derived and/or modified CDS sequence (AUadapt) from InfluenzaA__ACR08459__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggucgggcaucaucaucuccgacacccccgugcacgacugcgacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 2968 - RNA, 1701 nt, Artificial Sequence; identical to SEQ ID NO: 62
  derived and/or modified CDS sequence (AUadapt) from InfluenzaA__ACR08528__HA

SEQ ID NO: 2969 - RNA, 1701 nt, Artificial Sequence; identical to SEQ ID NO: 62
  derived and/or modified CDS sequence (AUadapt) from InfluenzaA__ACR08530__HA

SEQ ID NO: 2970 - RNA, 1701 nt, Artificial Sequence; identical to SEQ ID NO: 2967
  derived and/or modified CDS sequence (AUadapt) from InfluenzaA__ACR08531__HA

SEQ ID NO: 2971 - RNA, 1701 nt, Artificial Sequence; identical to SEQ ID NO: 116
  derived and/or modified CDS sequence (AUadapt) from InfluenzaA__ACR08533__HA

SEQ ID NO: 2972 - RNA, 1701 nt, Artificial Sequence; identical to SEQ ID NO: 2967
  derived and/or modified CDS sequence (AUadapt) from InfluenzaA__ACR08535__HA

SEQ ID NO: 2973 - RNA, 1701 nt, Artificial Sequence; identical to SEQ ID NO: 116
  derived and/or modified CDS sequence (AUadapt) from InfluenzaA__ACR08536__HA

SEQ ID NO: 2974 - RNA, 1701 nt, Artificial Sequence; identical to SEQ ID NO: 2967
  derived and/or modified CDS sequence (AUadapt) from InfluenzaA__ACR08537__HA

SEQ ID NO: 2975 - RNA, 1701 nt, Artificial Sequence; identical to SEQ ID NO: 2967
  derived and/or modified CDS sequence (AUadapt) from InfluenzaA__ACR08538__HA

SEQ ID NO: 2976 - RNA, 1701 nt, Artificial Sequence; identical to SEQ ID NO: 116
  derived and/or modified CDS sequence (AUadapt) from InfluenzaA__ACR08539__HA

SEQ ID NO: 2977 - RNA, 1701 nt, Artificial Sequence; identical to SEQ ID NO: 116
  derived and/or modified CDS sequence (AUadapt) from InfluenzaA__ACR08540__HA

SEQ ID NO: 2978 - RNA, 1701 nt, Artificial Sequence; identical to SEQ ID NO: 62
  derived and/or modified CDS sequence (AUadapt) from InfluenzaA__ACR08542__HA

SEQ ID NO: 2979 - RNA, 1701 nt, Artificial Sequence; identical to SEQ ID NO: 62
  derived and/or modified CDS sequence (AUadapt) from InfluenzaA__ACR08543__HA

SEQ ID NO: 2980 - RNA, 1701 nt, Artificial Sequence; identical to SEQ ID NO: 2940
  derived and/or modified CDS sequence (AUadapt) from InfluenzaA__ACR08544__HA

SEQ ID NO: 2981 - RNA, 1701 nt, Artificial Sequence; identical to SEQ ID NO: 2967
  derived and/or modified CDS sequence (AUadapt) from InfluenzaA__ACR08545__HA

SEQ ID NO: 2982 - RNA, 1701 nt, Artificial Sequence; identical to SEQ ID NO: 62
  derived and/or modified CDS sequence (AUadapt) from InfluenzaA__ACR08546__HA

SEQ ID NO: 2983 - RNA, 1701 nt, Artificial Sequence; identical to SEQ ID NO: 116
  derived and/or modified CDS sequence (AUadapt) from InfluenzaA__ACR08547__HA

SEQ ID NO: 2984 - RNA, 1701 nt, Artificial Sequence; identical to SEQ ID NO: 2967
  derived and/or modified CDS sequence (AUadapt) from InfluenzaA__ACR08548__HA

SEQ ID NO: 2985 - RNA, 1701 nt, Artificial Sequence; identical to SEQ ID NO: 116
  derived and/or modified CDS sequence (AUadapt) from InfluenzaA__ACR08549__HA

SEQ ID NO: 2986 - RNA, 1701 nt, Artificial Sequence; identical to SEQ ID NO: 116
  derived and/or modified CDS sequence (AUadapt) from InfluenzaA__ACR08550__HA

SEQ ID NO: 2987 - RNA, 1701 nt, Artificial Sequence; identical to SEQ ID NO: 116
  derived and/or modified CDS sequence (AUadapt) from InfluenzaA__ACR08551__HA

SEQ ID NO: 2988 - RNA, 1701 nt, Artificial Sequence; identical to SEQ ID NO: 62
  derived and/or modified CDS sequence (AUadapt) from InfluenzaA__ACR08552__HA

SEQ ID NO: 2989 - RNA, 1701 nt, Artificial Sequence; identical to SEQ ID NO: 2940
  derived and/or modified CDS sequence (AUadapt) from InfluenzaA__ACR08553__HA

SEQ ID NO: 2990 - RNA, 1701 nt, Artificial Sequence; identical to SEQ ID NO: 2940
  derived and/or modified CDS sequence (AUadapt) from InfluenzaA__ACR08554__HA

SEQ ID NO: 2991 - RNA, 1701 nt, Artificial Sequence; identical to SEQ ID NO: 62
  derived and/or modified CDS sequence (AUadapt) from InfluenzaA__ACR09365__HA

SEQ ID NO: 2992 - RNA, 1701 nt, Artificial Sequence; identical to SEQ ID NO: 62
  derived and/or modified CDS sequence (AUadapt) from InfluenzaA__ACR09366__HA

SEQ ID NO: 2993 - RNA, 1701 nt, Artificial Sequence; identical to SEQ ID NO: 62
  derived and/or modified CDS sequence (AUadapt) from InfluenzaA__ACR09367__HA

SEQ ID NO: 2994 - RNA, 1701 nt, Artificial Sequence; identical to SEQ ID NO: 62
  derived and/or modified CDS sequence (AUadapt) from InfluenzaA__ACR09368__HA

SEQ ID NO: 2995 - RNA, 1701 nt, Artificial Sequence; identical to SEQ ID NO: 62
  derived and/or modified CDS sequence (AUadapt) from InfluenzaA__ACR09369__HA

SEQ ID NO: 2996 - RNA, 1701 nt, Artificial Sequence; identical to SEQ ID NO: 62
  derived and/or modified CDS sequence (AUadapt) from InfluenzaA__ACR09370__HA

SEQ ID NO: 2997 - RNA, 1701 nt, Artificial Sequence; identical to SEQ ID NO: 62
  derived and/or modified CDS sequence (AUadapt) from InfluenzaA__ACR09371__HA

SEQ ID NO: 2998 - RNA, 1701 nt, Artificial Sequence; identical to SEQ ID NO: 62
  derived and/or modified CDS sequence (AUadapt) from InfluenzaA__ACR09373__HA

SEQ ID NO: 2999 - RNA, 1701 nt, Artificial Sequence; identical to SEQ ID NO: 62
  derived and/or modified CDS sequence (AUadapt) from InfluenzaA__ACR09374__HA

SEQ ID NO: 3000 - RNA, 1701 nt, Artificial Sequence
  derived and/or modified CDS sequence (AUadapt) from InfluenzaA__ACR09375__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagaagaacgccgggucgggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgucgauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgcgaggagaucgacggcgugaagcucgaguccacccggaucuaccagauccuggcgaucuacagcaccgucgccucgucccuggugcucguggucagccugggggccaucuccuucuggaugugcagcaacggcucccugcagugccgcaucugcaucuga

SEQ ID NO: 3001 - RNA, 1701 nt, Artificial Sequence; identical to SEQ ID NO: 62
  derived and/or modified CDS sequence (AUadapt) from InfluenzaA__ACR09376__HA

SEQ ID NO: 3002 - RNA, 1701 nt, Artificial Sequence; identical to SEQ ID NO: 62
  derived and/or modified CDS sequence (AUadapt) from InfluenzaA__ACR09377__HA

SEQ ID NO: 3003 - RNA, 1701 nt, Artificial Sequence; identical to SEQ ID NO: 62
  derived and/or modified CDS sequence (AUadapt) from InfluenzaA__ACR09395__HA

SEQ ID NO: 3004 - RNA, 1701 nt, Artificial Sequence; identical to SEQ ID NO: 62
  derived and/or modified CDS sequence (AUadapt) from InfluenzaA__ACR09396__HA

SEQ ID NO: 3005 - RNA, 1701 nt, Artificial Sequence
  derived and/or modified CDS sequence (AUadapt) from InfluenzaA__ACR10186__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaagaucgacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgagccugguccucguggugucccugggggccaucucguucuggaugugcuccaacggcagccugcagugccggaucugcaucuga

SEQ ID NO: 3006 - RNA, 1701 nt, Artificial Sequence; identical to SEQ ID NO: 3005
  derived and/or modified CDS sequence (AUadapt) from InfluenzaA__ACR10222__HA

SEQ ID NO: 3007 - RNA, 1701 nt, Artificial Sequence
  derived and/or modified CDS sequence (AUadapt) from InfluenzaA__ACR10223__HA
augaaggccauccuggugguccuccuguacaccuucaccacggccaacgcggacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagacguccucguccgacaacgggaccugcuaccccggcgacuucaucgacuacgaggagcuccgggagcagcugagcuccgugucguccuucgagcgcuucgagaucuuccccaagaccagcuccuggcccaaccacgacucgaacaagggcgucaccgccgccugcccgcacgccggcgccaaguccuucuacaagaaccugaucuggcucgugaagaaggggaacagcuaccccaagcuguccaagucguacaucaacgacaagggcaaggaggugcugguccucugggggauccaccaccccagcacguccgcggaccagcagucgcuguaccagaacgccgacgccuacguguucgugggcuccagccgguacuccaagaaguucaagcccgagaucgccauccgcccgaagguccgggaccaggagggccgcaugaacuacuacuggacccugguggagcccggggacaagaucaccuucgaggccaccggcaaccucguggucccccgguacgcguucgccauggagcgcaacgccgggucgggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgccaccggccugcgcaacgucccgucgauccagucccgggggcuguucggcgcgaucgccggguucaucgagggcggcuggacggggaugguggacggcugguacggguaccaccaccagaacgagcagggcagcggguacgccgccgaccucaaguccacccagaacgccaucgacgagaucaccaacaaggugaacucggucaucgagaagaugaacacccaguucacggcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggccaucuacagcaccgucgcgucgucccuggugcucguggucagccugggggccaucuccuucuggaugugcagcaacggcucccugcagugccggaucugcaucuga

SEQ ID NO: 3008 - RNA, 1701 nt, Artificial Sequence
  derived and/or modified CDS sequence (AUadapt) from InfluenzaA__ACR15183__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcuccaaggccuacuccaacugcuaccccuacgacgugccggacuacgcgucgcugcggucccucgucgccagcuccgggacgcuggaguucaacaacgagucguucaacuggaccggcgugacccagaacgggaccuccagcgccugcaagcgcggcuccgacaacucguucuucucccggcugaacuggcucacgcaccugaaguucaaguaccccgcccugaacgugaccaugcccaacaacgagaaguucgacaagcucuacaucuggggcguccaccaccccgggaccgacaacgaccagaucuucccguacgcgcaggccucgggccgcaucaccguguccacgaagcggagccagcagaccgugauccccaacaucgggucgcgcccccggguccgcaacauccccucccggaucucgaucuacuggaccaucgugaagccgggcgacauccugcugaucaacuccaccgggaaccucaucgcgccccgcggcuacuucaagauccggagcggcaaguccucgaucaugcgcuccgacgcccccaucgggaagugcaacagcgagugcaucacgcccaacggcuccaucccgaacgacaagcccuuccagaacgugaaccggaucaccuacggggccugcccccgcuacgucaagcagaacacccugaagcuggccaccggcaugcggaacgugcccgagaagcagacgcgcgggaucuucggcgccaucgccggcuucaucgagaacgggugggagggcaugguggacgggugguacggcuuccggcaccagaacucggaggggaucggccaggccgccgaccucaaguccacccaggcggccaucaaccagaucaacggcaagcugaaccgccugaucgggaagaccaacgagaaguuccaccagaucgagaaggaguucucggaggucgagggccggauccaggaccucgagaaguacguggaggacaccaagaucgaccugugguccuacaacgccgagcugcucguggcccuggagaaccagcacacgaucgaccugaccgacagcgagaugaacaagcuguucgagcgcaccaagaagcagcuccgggagaacgccgaggacauggggaacggcugcuucaagaucuaccacaagugcgacaacgcgugcaucggguccauccgcaacggcaccuacgaccacgacgucuaccgcgacgaggcccugaacaaccgguuccagaucaagggcguggagcucaagucgggguacaaggacuggauccuguggaucuccuucgccaucagcugcuuccugcucugcguggcccugcugggcuucaucaugugggccugccagaaggggaacauccgcugcaacaucugcaucuga

SEQ ID NO: 3009 - RNA, 1698 nt, Artificial Sequence
  derived and/or modified CDS sequence (AUadapt) from InfluenzaA__ACR15194__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccucguggcccaaccacacggucaccgggguguccgccagcugcucccacaacggcgagagcuccuucuaccgcaaccugcuguggcucaccgggaagaacggccuguaccccaaccugucgaaguccuacgccaacaacaaggagaaggaggugcucguccuguggggcgugcaccacccgcccaacaucggcaaccagaaggcccuguaccacaccgagaacgccuacgugagcgucgugagcucccacuacucgcggaaguucacgcccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcgggcugggcagcggcaucaucaacuccaacgcccccauggacaagugcgacgcgaagugccagacgccccagggggccaucaacagcucccugcccuuccagaacguccacccggugaccaucggcgagugccccaaguacgugcggucggccaagcuccgcauggucaccgggcugcggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacagcgucaucgagaagaugaacacccaguucaccgccguggggaaggaguucaacaagcucgagcggcgcauggagaaccugaacaagaaggucgacgacggcuucaucgacaucuggaccuacaacgccgagcugcucgugcugcuggagaacgagcggacgcucgacuuccacgacucgaacgugaagaaccuguacgagaaggucaagucccagcugaagaacaacgcgaaggagaucgggaaccgcugcuucgaguucuaccacaagugcaacgacgagugcauggagagcgugaagaacggcaccuacgacuaccccaaguacuccgaggagagcaagcucaaccgggagaagaucgacggggugaagcuggaguccaugggcgucuaccagauccuggccaucuacucgaccguggccagcucccucgugcugcuggucagccucggcgccaucuccuucuggaugugcagcaacgggucccugcagugccgcaucugcaucuga

SEQ ID NO: 3010 - RNA, 1698 nt, Artificial Sequence; identical to SEQ ID NO: 1115
  derived and/or modified CDS sequence (AUadapt) from InfluenzaA__ACR15216__HA

SEQ ID NO: 3011 - RNA, 1701 nt, Artificial Sequence
  derived and/or modified CDS sequence (AUadapt) from InfluenzaA__ACR15227__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucaacuggaccggcgugacccagaacgggaccuccagcgccugccagcgccgguccaacaagucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucucgcuguacgcgcagaccuccggccggaucacggugagcaccaagcgcucgcagcagaccgugaucccgaacaucggcucccggccccgcguccgggacgugcccucgcgcaucuccaucuacuggaccaucgugaagcccggggacauccugcucaucaacagcacgggcaaccugaucgccccgcggggguacuucaagauccgcuccggcaagucguccaucaugcggucggacgcccccaucggcaagugcaacuccgagugcaucacccccaacgggagcauccccaacgacaagccguuccagaacgucaaccgcaucaccuacggcgccugcccccgguacgugaagcagaacacccugaagcucgccacggggaugcgcaacgugcccgagcggcagacccgcggcaucuucggggcgaucgccggcuucaucgagaacggcugggaggggaugauggacggcugguacggguuccggcaccagaacuccgagggcaccgggcaggccgccgaccugaaguccacccaggccgcgaucaaccagaucaacggcaagcugaaccgccucaucggcaagacgaacgagaaguuccaccagaucgagaaggaguucuccgaggucgaggggcggauccaggaccuggagaaguacguggaggacaccaagaucgaccuguggucguacaacgccgagcuccugguggcccuggagaaccagcacaccaucgaccucaccgacuccgagaugaacaagcuguucgagcgcacgaagaagcagcugcgcgagaacgccgaggacaugggcaacgggugcuucaagaucuaccacaagugcgacaacgccugcaucggcucgauccggaacgggaccuacgaccacgacgucuaccgcgacgaggcgcucaacaaccgguuccagaucaagggcguggagcugaaguccggcuacaaggacuggauccuguggaucagcuucgccaucuccugcuuccuccugugcguggcccugcucggguucaucaugugggccugccagaagggcaacauccgcugcaacaucugcaucuga

SEQ ID NO: 3012 - RNA, 1698 nt, Artificial Sequence
  derived and/or modified CDS sequence (AUadapt) from InfluenzaA__ACR15238__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccucgguguccagcuucgagcgguucgagaucuucccgaaggaguccagcuggcccaaccacacggucaccgggguguccgccagcugcucccacaacggcgagucguccuucuaccgcaaccugcuguggcucaccgggaagaacggccuguaccccaaccugagcaaguccuacgccaacaacaaggagaaggaggugcucguccuguggggcgugcaccacccgcccaacaucggcgugcagaaggcccuguaccacaccgagaacgccuacgucagcguggugagcucccacuacucgcggaaguucacgcccgagaucgccaagcgccccaagguccgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacaagugcgacgcgaagugccagacgccccagggggccaucaacagcucccugcccuuccagaacgugcacccggugaccaucggcgagugccccaaguacguccggagcgccaagcugcgcauggugaccgggcuccggaacauccccuccauccagucgcgcggccuguucggggccaucgccggcuucaucgagggcggguggaccggcaugguggacgggugguacggcuaccagcaccagaacgagcagggguccggcuacgcggccgaccagaaguccacccagaacgccaucaacggcaucacgaacaaggucaacagcgugaucgagaagaugaacacccaguucaccgccgucgggaaggaguucaacaagcuggagcggcgcauggagaaccucaacaagaagguggacgacggcuucaucgacaucuggaccuacaacgccgagcugcuggugcuccuggagaacgagcggacgcuggacuuccacgacagcaacgucaagaaccucuacgagaaggugaagucccagcugaagaacaacgcgaaggagaucgggaacggcugcuucgaguucuaccacaagugcaacgacgagugcauggagagcgugaagaacgggaccuacgacuaccccaaguacuccgaggagucgaagcugaaccgcgagaagaucgacggcgucaagcucgaguccaugggcguguaccagauccuggccaucuacagcaccguggccagcucccugguccuccuggugagccugggggccaucuccuucuggaugugcagcaacggcucccuccagugccggaucugcaucuga

SEQ ID NO: 3013 - RNA, 1701 nt, Artificial Sequence
  derived and/or modified CDS sequence (AUadapt) from InfluenzaA__ACR15249__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacaacucguucuucucccgccugaacuggcucacgcacagcaaguucaaguaccccgcccugaacgugaccaugcccaacaacgagaaguucgacaagcuguacaucuggggcguccaccaccccgggaccgacaacgaccagaucuuccucuacgcgcaggccuccgggcggaucaccgugucgacgaagcgcagccagcagaccgugaucccgaacaucggcucccggccccgcguccggaacauccccucgcgcaucuccaucuacuggaccaucgugaagcccggcgacauccugcugaucaacagcaccgggaaccucaucgccccgcggggcuacuucaagauccgcuccgggaaguccuccaucaugcggucggacgcccccaucggcaagugcaacuccgagugcaucacgcccaacggcagcauccccaacgacaagccguuccagaacgugaaccgcaucaccuacggggccugcccccgguacgucaagcagaacacccugaagcuggcgaccggcaugcgcaacgugcccgagaagcagacgcgggggaucuucggcgccaucgccggguucaucgagaacggcugggagggcaugguggacgggugguacggcuuccgccaccagaacuccgaggggaucggccaggccgccgaccucaagucgacccaggcggccaucgaccagaucaacgggaagcugaaccggcugaucggcaagaccaacgagaaguuccaccagaucgagaaggaguucuccgaggucgagggccgcauccaggaccucgagaaguacguggaggacaccaagaucgaccuguggagcuacaacgccgagcugcucguggcccuggagaaccagcacacgaucgaccugaccgacuccgagaugaacaagcuguucgagaagaccaagaagcagcuccgggagaacgccgaggacauggggaacggcugcuucaagaucuaccacaagugcgacaacgcgugcaucgggucgauccgcaacggcaccuacgaccacgacgucuaccgcgacgaggcccugaacaaccgguuccagaucaaggggguggagcucaaguccggcuacaaggacuggauccuguggaucagcuucgccaucuccugcuuccugcucugcguggcccugcugggcuucaucaugugggccugccagaaggggaacauccgcugcaacaucugcaucuga

SEQ ID NO: 3014 - RNA, 1701 nt, Artificial Sequence
  derived and/or modified CDS sequence (AUadapt) from InfluenzaA__ACR15282__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaugaacgaccagaucgaggugaccaacgccacggagcugguccagagcuccucgaccggggagaucugcgacagcccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacccuggaguucaacaacgagagcuucaacuggacgggggugacccagaacggcaccuccucggccugcauccgccgguccaacaacagcuucuucucccgccugaacuggcucacccacucgaaguucaaguaccccgcccugaacgugacgaugcccaacaacgagaaguucgacaagcuguacaucuggggcguccaccaccccgggaccgacaacgaccagaucuuccucuacgcgcaggccuccgggcggaucaccgugagcaccaagcgcucgcagcagacggugaucccgaacaucggcucccggccccgcguccggaacauccccagccgcaucuccaucuacuggaccaucgugaagcccggcgacauccugcugaucaacucgaccgggaaccucaucgccccgcggggcuacuucaagauccgcuccgggaaguccuccaucaugcggagcgacgcccccaucggcaagugcaacuccgagugcaucacccccaacggcucgauccccaacgacaagccguuccagaacgugaaccgcaucacguacggggccugcccccgguacgucaagcagaacacccugaagcuggcgaccggcaugcgcaacgugcccgagaagcagacccgggggaucuucggcgccaucgccggguucaucgagaacggcugggagggcaugguggacgggugguacggcuuccgccaccagaacuccgaggggaucggccaggccgccgaccucaagagcacgcaggcggccaucgaccagaucaacgggaagcugaaccggcugaucggcaagaccaacgagaaguuccaccagaucgagaaggaguucuccgaggucgagggccgcauccaggaccucgagaaguacguggaggacaccaagaucgaccuguggucguacaacgccgagcugcucguggcccuggagaaccagcacaccaucgaccugacggacuccgagaugaacaagcuguucgagaagaccaagaagcagcuccgggagaacgccgaggacauggggaacggcugcuucaagaucuaccacaagugcgacaacgcgugcaucgggagcauccgcaacggcaccuacgaccacgacgucuaccgcgacgaggcccugaacaaccgguuccagaucaaggggguggagcucaaguccggcuacaaggacuggauccuguggaucagcuucgccaucuccugcuuccugcucugcguggcccugcugggcuucaucaugugggccugccagaaggggaacauccgcugcaacaucugcaucuga

SEQ ID NO: 3015 - RNA, 1701 nt, Artificial Sequence
  derived and/or modified CDS sequence (AUadapt) from InfluenzaA__ACR15293__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucaucgccucguccgggacgcuggaguucaacaacgagaacuucaacuggaccggcgucacccagaacgggaccagcuccgccugcaagcgcggcucggacaacuccuucuucagccggcugaacuggcucacgcaccugaaguucaaguaccccgcccugaaggugaccaugcccaacaacgagaaguucgacaagcucuacaucuggggcgugcaccaccccgggaccgacaacgaccagaucuuccuguacgcgcaggccuccggccgcaucaccgucucgacgaagcggucccagcagaccgugaucccgaacaucgggucgcgcccccgggugcgcaacauccccagccggaucuccaucuacuggaccaucgucaagcccggcgacauccugcucaucaacucgaccgggaaccugaucgccccgcgcggcuacuucaagauccgguccggcaagagcuccaucaugcgcucggacgcccccaucgggaagugcaacuccgagugcaucacgcccaacggcucgauccccaacgacaagccguuccagaacgugaaccggaucaccuacggggccugcccccgcuacgugaagcagaacacccugaagcucgcgaccggcaugcggaacguccccgagaagcagacgcgcgggaucuucggcgccaucgccggcuucaucgagaacgggugggagggcaugguggacgggugguacggcuuccggcaccagaacuccgaggggaucggccaggccgccgaccugaaguccacccaggcggccaucaaccagaucaacggcaagcugaaccgccucaucgggaagaccaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacacgaucgaccucaccgacuccgagaugaacaagcuguucgagcgcaccaagaagcagcugcgggagaacgccgaggacauggggaacggcugcuucaagaucuaccacaagugcgacaacgcgugcaucgggucgauccgcaacggcaccuacgaccacgacguguaccgcgacgaggcccucaacaaccgguuccagaucaagggcgucgagcugaaguccggguacaaggacuggauccuguggaucagcuucgccaucuccugcuuccuccugugcguggcccugcucggcuucaucaugugggccugccagaaggggaacauccgcugcaacaucugcaucuga

SEQ ID NO: 3016 - RNA, 1698 nt, Artificial Sequence
  derived and/or modified CDS sequence (AUadapt) from InfluenzaA__ACR15304__HA
augaaggccaagcugcucgugcugcugugcaccuucaccgccacguacgcggacaccaucugcaucggcuaccacgccaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggucguacaucgucgagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgugaccggggucuccgccucgugcucccacaacggcaagagcuccuucuaccgcaaccugcuguggcucaccgggaagaacggccuguaccccaaccugagcaaguccuacgccaacaacaaggagaaggaggugcucgugcuguggggcguccaccacccgcccaacacggggaaccagcgggcccuguaccacaccgagaacgccuacgugucgguggucagcucccacuacagccgccgguucacccccgagaucgcgaagcgccccaaggugcgggaccaggagggccgcaucaacuacuacuggacccuccuggagcccggggacacgaucaucuucgaggccaacggcaaccugaucgccccgugguacgccuucgcccucucccggggguucggcagcggcaucaucaccuccaacgcgcccauggacgagugcgacgccaagugccagacgccccagggggccaucaacucgucccugcccuuccagaacgugcacccggucaccaucggcgagugccccaaguacgugcgcagcgccaagcugcggauggugaccgggcuccgcaacauccccuccauccagagccggggccuguucggggccaucgcgggcuucaucgagggcggguggaccggcauggucgacgggugguacggcuaccaccaccagaacgagcagggguccggcuacgccgccgaccagaaguccacccagaacgccaucaacggcaucaccaacaaggugaacucggugaucgagaagaugaacacgcaguucaccgccgucgggaaggaguucaaccgccuggagcggcgcauggagaaccucaacaagaagguggacgacggcuuccuggacaucuggaccuacaacgcggagcugcucguccugcuggagaacgagcggacccucgacuuccacgacagcaacgugaagaaccuguacgagaaggugaagucccagcugaagaacaacgccaaggagaucgggaacggcugcuucgaguucuaccacaagugcaacaacgagugcauggagagcgucaagaacgggacguacgacuaccccaaguacuccgaggagagcaagcucaaccgcgagaagaucgacggcgugaagcuggaguccaugggcguguaccagauccuggccaucuacucgaccgucgccagcucccucgugcugcuggugagccucggggccaucuccuucuggaugugcagcaacggcucccugcagugccggaucugcaucuga

SEQ ID NO: 3017 - RNA, 1698 nt, Artificial Sequence
  derived and/or modified CDS sequence (AUadapt) from InfluenzaA__ACR15315__HA
augaaggccaagcugcucgugcugcugugcaccuucaccgccacguacgcggacaccaucugcaucggcuaccacgccaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaagggguccucguggcccaaccacaccgugaccggcgucuccgccagcugcucccacaacggcaagagcuccuucuaccgcaaccugcuguggcucaccgggaagaacgggcuguaccccaaccugagcauguccuacgugaacaacaaggagaaggaggugcucguccuguggggcgugcaccacccgcccaacauccgggaccagcgcgcccuguaccacacggagaacgccuacgugagcgucgugagcucccacuacucgcggcgcuucacccccgagaucgccaagcggcccaaggugcgcgaccaggagggccggaucaacuacuacuggacccuccuggagcccggggacaccaucaucuucgaggcgaacggcaaccugaucgccccgugguacgccuucgcccucucccgcggguucggcagcggcaucaucacguccaacgcccccaugggggagugcgacgcgaagugccagacgccccagggcgccaucaacagcucccugcccuuccagaacguccacccggugaccaucggggagugccccaaguacgugcggagcgccaagcugcgcauggucaccggccuccggaacauccccuccauccagagccgcgggcuguucggcgccaucgccggcuucaucgagggcggguggaccgggaugguggacggcugguacggguaccaccaccagaacgagcagggcuccggcuacgcggccgaccagaaguccacccagaacgccaucaacgggaucaccaacaaggugaacagcgucaucgagaagaugaacacccaguucacggccgugggcaaggaguucaacaagcuggagcggcgcauggagaaccucaacaagaaggucgacgacggguuccuggacaucuggaccuacaacgccgagcugcucgugcugcuggagaacgagcggacccucgacuuccacgacucgaacgugaagaaccuguacgagaaggucaagucccagcugaagaacaacgcgaaggagaucggcaacgggugcuucgaguucuaccacaagugcaacaacgagugcauggagagcgugaagaacggcaccuacgacuaccccaaguacuccgaggagagcaagcucaaccgcgagaagaucgacggcgugaagcuggaguccaugggggucuaccagauccuggccaucuacagcacgguggccagcucccucgugcugcuggucagccucggcgccaucuccuucuggaugugcagcaacgggucccugcagugccggaucugcaucuga

SEQ ID NO: 3018 - RNA, 1698 nt, Artificial Sequence
  derived and/or modified CDS sequence (AUadapt) from InfluenzaA__ACR15326__HA
augaaggccaagcugcucgugcugcugugcaccuucaccgccacguacgcggacaccaucugcaucggcuaccacgccaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaagggguccucguggcccaaccacaccgugaccggcgucuccgccagcugcucccacaacggcaagagcuccuucuaccgcaaccugcuguggcucaccgggaagaacgggcuguaccccaaccugagcauguccuacgugaacaacaaggagaaggaggugcucguccuguggggcgugcaccacccgcccaacaucggcaaccagcgggcccuguaccacacggagaacgccuacgugagcgucgugagcucccacuacucgcgccgguucacccccgagaucgccaagcgccccaaggugcgggaccaggaggggcgcaucaacuacuacuggacccuccuggagcccggcgacaccaucaucuucgaggcgaacgggaaccugaucgccccgugguacgccuucgcccucucccggggcuucggcagcgggaucaucacguccaacgcccccaugggcgagugcgacgagaagugccagacgccccagggggcgaucaacagcucccugcccuuccagaacguccacccggugaccaucggcgagugccccaaguacgugcgcagcgccaagcugcggauggucaccgggcuccgcaacauccccuccauccagagccggggccuguucggcgccaucgccggguucaucgagggcggguggaccggcaugguggacgggugguacggcuaccaccaccagaacgagcagggcuccggguacgccgcggaccagaaguccacccagaacgccaucaacggcaucaccaacaaggugaacagcgucaucgagaagaugaacacccaguucacggccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacucgaacgugaagaaccuguacgagaaggucaagucccagcugaagaacaacgccaaggagaucgggaacggcugcuucgaguucuaccacaagugcaacaacgagugcauggagagcgugaagaacggcaccuacgacuaccccaaguacuccgaggagagcaagcucaaccgggagaagaucgacggggugaagcuggaguccaugggcgucuaccagauccuggcgaucuacagcacgguggccagcucccucgugcugcuggucagccucggggccaucuccuucuggaugugcagcaacggcucccugcagugccgcaucugcaucuga

SEQ ID NO: 3019 - RNA, 1698 nt, Artificial Sequence
  derived and/or modified CDS sequence (AUadapt) from InfluenzaA__ACR15359__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcggccuccugaucagcaaggaguccuggucguacaucguggagaagcccaaccccgagaacgggaccugcuaccccgggcacuucgccgacuacgaggagcugcgcgagcagcucuccagcguguccagcuucgagcgguucgagaucuucccgaaggaguccagcuggcccaaccacacggucaccggcguguccgccucgugcucccacaacggggagagcuccuucuaccgcaaccugcuguggcucaccggcaagaacgggcuguaccccaaccugagcaaguccuacgccaacaacaaggagaaggaggugcucguccuguggggcgugcaccacccgcccaacaucggcgaccagaaggcccuguaccacaccgagaacgccuacgugucggucgugagcucccacuacagccggaaguucacgcccgagaucgccaagcgccccaaggugcgggaccaggaggggcgcaucaacuacuacuggacccuccuggagcccggcgacaccaucaucuucgaggcgaacgggaaccugaucgccccgcgguacgccuucgcccucucccgcggcuucggcagcgggaucaucaacuccaacgcccccauggacaagugcgacgcgaagugccagacgccccagggcgccaucaacucgucccugcccuuccagaacguccacccggugaccaucggggagugccccaaguacgugcggagcgccaagcugcgcauggucaccggccuccggaacauccccuccauccagagccgcgggcuguucggcgccaucgccggcuucaucgagggcggcuggaccgggaugguggacggcugguacggguaccaccaccagaacgagcagggcuccggcuacgcggccgaccagaaguccacccagaacgccaucaacgggaucacgaacaaggugaacucggucaucgagaagaugaacacccaguucaccgccgugggcaaggaguucaacaagcuggagcggcgcauggagaaccucaacaagaaggucgacgacggguucaucgacaucuggaccuacaacgccgagcugcuggugcuccuggagaacgagcggacgcuggacuuccacgacagcaacgugaagaaccucuacgagaaggucaagucccagcugaagaacaacgcgaaggagaucggcaacgggugcuucgaguucuaccacaagugcaacgacgagugcauggagagcgugaagaacggcaccuacgacuaccccaaguacuccgaggagagcaagcugaaccgcgagaagaucgacggcgugaagcucgaguccaugggggucuaccagauccuggccaucuacucgaccguggccagcucccuggugcuccuggucagccugggcgccaucuccuucuggaugugcagcaacgggucccuccagugccggaucugcaucuga

SEQ ID NO: 3020 - RNA, 1698 nt, Artificial Sequence
  derived and/or modified CDS sequence (AUadapt) from InfluenzaA__ACR15370__HA
augaaggugaagcugcucguccugcugugcacccucaccgccacguacgccgacaccaucugcaucggcuaccacgcgaacaacucgaccgacaccguggacacggugcuggagaagaacgucaccgugacccacuccgugaaccugcucgagaacagccacaacgggaagcugugccugcucaagggcaucgcgccccugcagcuggggaacugcuccgucgccggcuggauccucgggaacccggagugcgagcugcugaucagcaaggaguccuggucguacaucguggagaagcccaaccccgagaacgggaccugcuaccccggccacuucgccgacuacgaggagcuccgcgagcagcuguccagcguguccagcuucgagcgguucgagaucuucccgaaggaguccucguggcccaaccacacggucaccgggguguccgccagcugcucccacaacggcgagagcuccuucuaccgcaaccugcucuggcugaccgggaagaacggccuguaccccaaccucucgaaguccuacgccaacaacaaggagaaggaggugcugguccuguggggcgugcaccacccgcccaacaucggcgaccagaaggcccucuaccacaccgagaacgccuacgugagcgucgugagcucccacuacucgcggaaguucacgcccgagaucgccaagcgccccaaggugcgggaccaggagggccgcaucaacuacuacuggacccugcuggagcccggggacaccaucaucuucgaggcgaacggcaaccucaucgccccgcgguacgccuucgcccugucccgcggguucggcagcggcaucaucaacuccaacgcccccauggacaagugcgacgcgaagugccagacgccccagggggccaucaacagcucccugcccuuccagaacguccacccggugaccaucggcgagugccccaaguacgugcggucggccaagcuccgcauggucaccgggcugcggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacagcgucaucgagaagaugaacacccaguucaccgccguggggaaggaguucaacaagcucgagcggcgcauggagaaccugaacaagaaggucgacgacggcuucaucgacaucuggaccuacaacgccgagcugcucgugcugcuggagaacgagcggacgcucgacuuccacgacucgaacgugaagaaccuguacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcucaaccgcgagaagaucgacggcgugaagcuggaguccaugggcgucuaccagauccuggccaucuacucgaccguggccagcucccucauccugcuggugagccucggggccaucuccuucuggaugugcagcaacggcucccugcagugccggaucugcaucuga

SEQ ID NO: 3021 - RNA, 1701 nt, Artificial Sequence; identical to SEQ ID NO: 2546
  derived and/or modified CDS sequence (AUadapt) from InfluenzaA__ACR15381__HA

SEQ ID NO: 3022 - RNA, 1701 nt, Artificial Sequence; identical to SEQ ID NO: 2553
  derived and/or modified CDS sequence (AUadapt) from InfluenzaA__ACR15392__HA

SEQ ID NO: 3023 - RNA, 1701 nt, Artificial Sequence; identical to SEQ ID NO: 2173
  derived and/or modified CDS sequence (AUadapt) from InfluenzaA__ACR15403__HA

SEQ ID NO: 3024 - RNA, 1701 nt, Artificial Sequence; identical to SEQ ID NO: 2173
  derived and/or modified CDS sequence (AUadapt) from InfluenzaA__ACR15414__HA

SEQ ID NO: 3025 - RNA, 1698 nt, Artificial Sequence; identical to SEQ ID NO: 3019
  derived and/or modified CDS sequence (AUadapt) from InfluenzaA__ACR15425__HA

SEQ ID NO: 3026 - RNA, 1698 nt, Artificial Sequence
  derived and/or modified CDS sequence (AUadapt) from InfluenzaA__ACR15436__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccucgugcucccacaacggcgagagcuccuucuaccgcaaccugcuguggcucaccgggaagaacggccuguaccccaaccugagcaaguccuacgccaacaacaaggggaaggaggugcucguccuguggggcgugcaccacccgcccaacaucggcgaccagaacacccuguaccacacggagaacgccuacgugucggucgugagcucccacuacagccggaaguucacccccgagaucgccaagcgccccaaggugcgggaccaggaggggcgcaucaacuacuacuggacccuccuggagcccggcgacaccaucaucuucgaggccaacgggaaccugaucgcgccgcgguacgccuucgcccucucccgcggcuucggcagcgggaucaucaacuccaacgcccccauggacaagugcgacgccaagugccagacgccccagggcgcgaucaacucgucccugcccuuccagaacguccacccggugaccaucggggagugccccaaguacgugcggagcgccaagcugcgcauggucaccggccuccggaacauccccuccauccagagccgcgggcuguucggcgccaucgccggcuucaucgagggcggcuggaccgggaugguggacggcugguacggguaccaccaccagaacgagcagggcuccggcuacgccgcggaccagaaguccacgcagaacgccaucaacgggaucaccaacaaggugaacucggucaucgagaagaugaacacccaguucaccgccgugggcaaggaguucaacaagcuggagcggcgcauggagaaccucaacaagaaggucgacgacggguucaucgacaucuggacguacaacgccgagcugcuggugcuccuggagaacgagcggacccuggacuuccacgacagcaacgugaagaaccucuacgagaaggucaagucccagcugaagaacaacgccaaggagaucggcaacgggugcuucgaguucuaccacaagugcaacgacgagugcauggagagcgugaagaacggcaccuacgacuaccccaaguacuccgaggagagcaagcugaaccgcgagaagaucgacggcgugaagcucgaguccaugggggucuaccagauccuggcgaucuacucgaccguggccagcucccuggugcuccuggucagccugggcgccaucuccuucuggaugugcagcaacgggucccuccagugccggaucugcaucuga

SEQ ID NO: 3027 - RNA, 1698 nt, Artificial Sequence
  derived and/or modified CDS sequence (AUadapt) from InfluenzaA__ACR15458__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaaccccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccucgugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugucggucgugagcucccacuacagccggaaguucacgcccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacaagugcgacgcgaagugccagacgccccagggggccaucaacucgucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacucggucaucgagaagaugaacacccaguucaccgccguggggaaggaguucaacaagcuggagcggcgcauggagaaccucaacaagaaggucgacgacggcuucaucgacaucuggaccuacaacgccgagcugcuggugcuccuggagaacgagcggacgcuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgugaagcucgaguccaugggcgucuaccagauccuggccaucuacucgaccguggccagcucccuggugcuccuggucagccugggggccaucuccuucuggaugugcagcaacggcucccuccagugccggaucugcaucuga

SEQ ID NO: 3028 - RNA, 1698 nt, Artificial Sequence
  derived and/or modified CDS sequence (AUadapt) from InfluenzaA__ACR15469__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccgaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccucgugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaacacccuguaccacacggagaacgccuacgugucggucgugagcucccacuacagccggaaguucacccccgagaucgccaagcgccccaaggugcgggaccaggagggccgcaucaacuacuacuggacccuccuggagcccggggacaccaucaucuucgaggccaacggcaaccugaucgcgccgcgguacgccuucgcccucucccgcggguucggcagcggcaucaucaacuccaacgcccccauggacaagugcgacgccaagugccagacgccccagggggcgaucaacucgucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgccgcggaccagaaguccacgcagaacgccaucaacggcaucaccaacaaggugaacucggucaucgagaagaugaacacccaguucaccgccguggggaaggaguucaacaagcuggagcggcgcauggagaaccucaacaagaaggucgacgacggcuucaucgacaucuggacguacaacgccgagcugcuggugcuccuggagaacgagcggacccuggacuuccacgacagcaacgugaagaaccucuacgagaaggucaagucccagcugaagaacaacgccaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgugaagcucgaguccaugggcgucuaccagauccuggcgaucuacucgaccguggccagcucccuggugcuccuggucagccugggggccaucuccuucuggaugugcagcaacggcucccuccagugccggaucugcaucuga

SEQ ID NO: 3029 - RNA, 1698 nt, Artificial Sequence; identical to SEQ ID NO: 3026
  derived and/or modified CDS sequence (AUadapt) from InfluenzaA__ACR15480__HA

SEQ ID NO: 3030 - RNA, 1698 nt, Artificial Sequence
  derived and/or modified CDS sequence (AUadapt) from InfluenzaA__ACR15491__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccucgguguccagcuucgagcgguucgagaucuucccgaaggaguccagcuggcccaaccacacggucaccgggguguccgccagcugcucccacaacggcgagucguccuucuaccgcaaccugcuguggcucaccgggcggaacggccuguaccccaaccugagcaaguccuacgccaacaacaaggagaaggaggugcucguccuguggggcgugcaccacccgcccaacaucguggaccagaagacccuguaccgcacggagaacgccuacgucagcguggugagcucccacuacucgcggaaguucacccccgagaucgccaagcgccccaagguccgggaccaggagggccgcaucaacuacuacuggacccuccuggagcccggcgacaccaucaucuucgaggccaacgggaaccugaucgcgccgcgguacgccuucgcccucucccgcggcuucgggagcggcaucaucaacuccaacgcccccauggacaagugcgacgccaagugccagacgccccagggcgcgaucaacagcucccugcccuuccagaacgugcacccggugaccaucggggagugccccaaguacguccggagcgccaagcugcgcauggugaccggccuccggaacauccccuccauccagucgcgcgggcuguucggcgccaucgccggguucaucgagggcggcuggaccgggaugguggacggcugguacggguaccaccaccagaacgagcagggcuccggguacgccgcggaccagaaguccacgcagaacgccaucaacggcaucaccaacaaggucaacagcgugaucgagaagaugaacacccaguucaccgccgucggcaaggaguucaacaagcuggagcggcgcauggagaaccucaacaagaagguggacgacggguucaucgacaucuggacguacaacgccgagcugcuggugcuccuggagaacgagcggacccuggacuuccacgacagcaacgucaagaaccucuacgagaaggugaagucccagcugaagaacaacgccaaggagaucggcaacgggugcuucgaguucuaccacaagugcaacgacgagugcauggagagcgugaagaacggcaccuacgacuaccccaaguacuccgaggagucgaagcugaaccgcgagaagaucgacgggaucaagcucgaguccaugggcgucuaccagauccuggcgaucuacagcaccguggccagcucccuggugcuccuggucagccugggcgccaucuccuucuggaugugcagcaacgggucccuccagugccggaucugcaucuga

SEQ ID NO: 3031 - RNA, 1698 nt, Artificial Sequence
  derived and/or modified CDS sequence (AUadapt) from InfluenzaA__ACR15502__HA
augaaggugaagcugcucguccugcugugcaccuucaccgccacguacgccgacaccaucugcaucggcuaccacgcgaacaacgccaccgacaccguggacacggugcucgagaagaacgucaccgugacccacucggugaaccugcuggagaacucccacaacgggaagcucugccugcugaagggcaucgcgccccuccagcuggggaacugcagcgucgccggcuggauccuggggaacccggagugcgagcuccugaucuccaaggagagcugguccuacaucguggagaagcccaaccccgagaacgggaccugcuaccccggccacuucgccgacuacgaggagcugcgcgagcagcucucguccgugagcuccuucgagcgguucgagaucuucccgaaggagagcuccuggcccaaccacacggucaccggggugucggccuccugcagccacaacggcgaguccagcuucuaccgcaaccugcuguggcucaccgggaagaacggccuguaccccaaccuguccaagucguacgccaacaacaaggggaaggaggugcucguccuguggggcgugcaccacccgcccaacaucggcgaccagaacacccuguaccacacggagaacgccuacguguccgucgugagcagccacuacucccggaaguucacccccgagaucgccaagcgccccaaggugcgggaccaggaggggcgcaucaacuacuacuggacccuccuggagcccggcgacaccaucaucuucgaggcgaacgggaaccugaucgccccgcgguacgccuucgcccucucgcgcggcuucggcuccgggaucaucaacagcaacgcccccauggacaagugcgacgcgaagugccagacgccccagggcgccaucaacuccagccugcccuuccagaacguccacccggugaccaucggggagugccccaaguacgugcgguccgccaagcugcgcauggucaccggccuccggaacauccccucgauccagucccgcgggcuguucggcgccaucgccggcuucaucgagggcggcuggaccgggaugguggacggcugguacggguaccaccaccagaacgagcagggcagcggcuacgcggccgaccagaaguccacgcagaacgccaucaacgggaucaccaacaaggugaacagcgucaucgagaagaugaacacccaguucaccgccgugggcaaggaguucaacaagcuggagcggcgcauggagaaccucaacaagaaggucgacgacggguucaucgacaucuggacguacaacgccgagcugcuggugcuccuggagaacgagcggacccuggacuuccacgacuccaacgugaagaaccucuacgagaaggucaagucgcagcugaagaacaacgcgaaggagaucggcaacgggugcuucgaguucuaccacaagugcaacgacgagugcauggaguccgugaagaacggcaccuacgacuaccccaaguacagcgaggaguccaagcugaaccgcgagaagaucgacggcgugaagcucgagagcaugggggucuaccagauccuggccaucuacuccaccguggccucgagccuggugcuccuggucucccugggcgccaucagcuucuggaugugcuccaacgggagccuccagugccggaucugcaucuga

SEQ ID NO: 3032 - RNA, 1698 nt, Artificial Sequence; identical to SEQ ID NO: 2888
  derived and/or modified CDS sequence (AUadapt) from InfluenzaA__ACR15513__HA

SEQ ID NO: 3033 - RNA, 1701 nt, Artificial Sequence
  derived and/or modified CDS sequence (AUadapt) from InfluenzaA__ACR15524__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucgucgccucguccgggacgcuggaguucaacaacgagagcuucaacuggaccggcgugacccagaacgggaccuccucggccugcaagcgccgguccaacaagagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucucgcuguacgcgcaggccuccggccggaucaccgugucgacgaagcgcagccagcagaccgugaucccgaacaucggcucccggccccgcguccgggacgugcccucgcgcaucuccaucuacuggaccaucgugaaguccggggacauccugcucaucaacuccaccggcaaccugaucgcgccccggggguacuucaagauccgcagcggcaaguccucgaucaugcgguccgacgccccgaucggcaagugcaacucggagugcaucacgcccaacggguccauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacagcgagggcaccgggcaggccgccgaccugaaguccacccaggcggccaucaaccagaucaacggcaagcugaaccggcucaucggcaagaccaacgagaaguuccaccagaucgagaaggaguucucggagguggaggggcgcauccaggaccuggagaaguacguggaggacacgaagaucgaccugugguccuacaacgccgagcuccuggucgcccuggagaaccagcacaccaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggacguacgaccacgacguguaccgggacgaggcccucaacaaccgcuuccagaucaagggcguggagcucaagucgggcuacaaggacuggauccuguggaucuccuucgccaucagcugcuuccugcugugcgucgugcugcucggguucaucaugugggccugccagaagggcaacauccggugcaacaucugcaucuga

SEQ ID NO: 3034 - RNA, 1701 nt, Artificial Sequence; identical to SEQ ID NO: 2842
  derived and/or modified CDS sequence (AUadapt) from InfluenzaA__ACR15535__HA

SEQ ID NO: 3035 - RNA, 1701 nt, Artificial Sequence
  derived and/or modified CDS sequence (AUadapt) from InfluenzaA__ACR15546__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccacauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucaacuggaccggcgugacccagaacgggaccuccagcgccugcaagcgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucaccgugucgacgaagcgcucgcagcagaccgugaucccgaacaucggcucccggccccgcguccgggacaucagcucccgcaucucgaucuacuggaccaucgugaagcccggggacauccugcucaucaacuccaccggcaaccugaucgcgccccggggguacuucaagauccgcucgggcaaguccagcaucaugcgguccgacgccccgaucggcaagugcaacucggagugcaucacgcccaacggguccauccccaacgacaagcccuuccagaacgugaaccgcaucaccuacggcgccugcccgcgguacgucaagcagaacacccugaagcucgccaccgggaugcgcaacgugcccgagacgcagacccggggcaucuucggggccaucgccggcuucaucgagaacggcugggaggggaugguggacggcugguacggguuccgccaccagaacucggagggcaccgggcaggccgccgaccugaaguccacccaggcggccaucaaccagaucaacggcaagcugaaccggcucaucggcaagacgaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacaccaucgaccucaccgacucggagaugaacaagcuguucgagcggacgaagaagcagcugcgcgagaacgccgaggacaugggcaacgggugcuucaagaucuaccacaagugcgacaacgcgugcaucggcuccauccgcaacgagaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 3036 - RNA, 1701 nt, Artificial Sequence; identical to SEQ ID NO: 2617
  derived and/or modified CDS sequence (AUadapt) from InfluenzaA__ACR15557__HA

SEQ ID NO: 3037 - RNA, 1701 nt, Artificial Sequence; identical to SEQ ID NO: 875
  derived and/or modified CDS sequence (AUadapt) from InfluenzaA__ACR15568__HA

SEQ ID NO: 3038 - RNA, 1701 nt, Artificial Sequence
  derived and/or modified CDS sequence (AUadapt) from InfluenzaA__ACR15579__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucgucgccagcuccgggacgcuggaguucaacaacgagucguucaacuggaccggcgugacccagaacgggaccuccucggccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccucgggccggaucaccguguccacgaagcgcagccagcagaccgugaucccgaacaucggcucgcggccccgcguccggaacauccccucccgcaucagcaucuacuggaccaucgugaaccccggggacauccugcucaucaacuccaccggcaaccugaucgccccgcggggguacuucaagauccgcucgggcaaguccucgaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacucggagggcaucgggcaggccgccgaccugaaguccacccaggcggccaucaaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacacgaucgaccucaccgacucggagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 3039 - RNA, 1701 nt, Artificial Sequence
  derived and/or modified CDS sequence (AUadapt) from InfluenzaA__ACR15590__HA
augaagaccaucaucgcccugucguacauccucugccugguguucacccagaagcugcccggcaacgacaacuccacggccacccucugccuggggcaccacgcggucccgaacggcaccaucgugaagaccaucacgaacgaccagaucgaggugaccaacgccaccgagcugguccagucguccagcaccgggggcaucugcgacucgccccaccagauccucgacggggagaacugcacgcugaucgacgcccugcucggcgacccccagugcgacggcuuccagaacaagaagugggaccuguucguggagcgcagcaaggccuacuccaacugcuaccccuacgacgugccggacuacgccucgcugcggucccucgucgcgagcuccgggacccuggaguucaacaacgagucguucaacuggaccggcgugacccagaacgggacguccucggccugcaagcgccgguccaacaacagcuucuucucccgccugaacuggcucacccaccugaaguucaaguaccccgcccugaacgugaccaugcccaacaacgagaaguucgacaagcucuacaucuggggcguccaccaccccgggaccgacaacgaccagaucuuccuguacgcccaggcgucgggccggaucacgguguccaccaagcgcagccagcagaccgugaucccgaacaucggcucgcggccccgcguccggaacauccccucccgcaucagcaucuacuggaccaucgugaagcccggggacauccugcucaucaacuccacgggcaaccugaucgccccgcggggguacuucaagauccgcucgggcaaguccucgaucaugcgguccgacgcccccaucggcaagugcaacagcgagugcaucacccccaacggguccauccccaacgacaagccguuccagaacgugaaccgcaucaccuacggcgccugcccccgguacgucaagcagaacacccugaagcucgccacggggaugcgcaacgugcccgagaagcagacccggggcaucuucggggcgaucgccggcuucaucgagaacggcugggaggggaugguggacggcugguacggguuccgccaccagaacucggagggcaucgggcaggccgccgaccugaaguccacccaggccgcgaucaaccagaucaacggcaagcugaaccggcucaucggcaagaccaacgagaaguuccaccagaucgagaaggaguucagcgaggucgaggggcgcauccaggaccuggagaaguacguggaggacacgaagaucgaccugugguccuacaacgccgagcuccugguggcccuggagaaccagcacaccaucgaccucaccgacucggagaugaacaagcuguucgagcggaccaagaagcagcugcgcgagaacgccgaggacaugggcaacgggugcuucaagaucuaccacaagugcgacaacgccugcaucggcuccauccgcaacgggacguacgaccacgacgucuaccgggacgaggcgcucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 3040 - RNA, 1701 nt, Artificial Sequence; identical to SEQ ID NO: 875
  derived and/or modified CDS sequence (AUadapt) from InfluenzaA__ACR15601__HA

SEQ ID NO: 3041 - RNA, 1701 nt, Artificial Sequence
  derived and/or modified CDS sequence (AUadapt) from InfluenzaA__ACR18920__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcuccucgcgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccucgcugcccuuccagaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacauccaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 3042 - RNA, 1701 nt, Artificial Sequence; identical to SEQ ID NO: 116
  derived and/or modified CDS sequence (AUadapt) from InfluenzaA__ACR18975__HA

SEQ ID NO: 3043 - RNA, 1701 nt, Artificial Sequence; identical to SEQ ID NO: 62
  derived and/or modified CDS sequence (AUadapt) from InfluenzaA__ACR18976__HA

SEQ ID NO: 3044 - RNA, 1701 nt, Artificial Sequence; identical to SEQ ID NO: 62
  derived and/or modified CDS sequence (AUadapt) from InfluenzaA__ACR18977__HA

SEQ ID NO: 3045 - RNA, 1701 nt, Artificial Sequence; identical to SEQ ID NO: 116
  derived and/or modified CDS sequence (AUadapt) from InfluenzaA__ACR18978__HA

SEQ ID NO: 3046 - RNA, 1701 nt, Artificial Sequence; identical to SEQ ID NO: 62
  derived and/or modified CDS sequence (AUadapt) from InfluenzaA__ACR18979__HA

SEQ ID NO: 3047 - RNA, 1701 nt, Artificial Sequence; identical to SEQ ID NO: 2967
  derived and/or modified CDS sequence (AUadapt) from InfluenzaA__ACR18981__HA

SEQ ID NO: 3048 - RNA, 1701 nt, Artificial Sequence; identical to SEQ ID NO: 62
  derived and/or modified CDS sequence (AUadapt) from InfluenzaA__ACR18982__HA

SEQ ID NO: 3049 - RNA, 1701 nt, Artificial Sequence; identical to SEQ ID NO: 116
  derived and/or modified CDS sequence (AUadapt) from InfluenzaA__ACR18988__HA

SEQ ID NO: 3050 - RNA, 1701 nt, Artificial Sequence
  derived and/or modified CDS sequence (AUadapt) from InfluenzaA__ACR18991__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaaccgcaagcucugcaagcugcgcggggucgcgccccugcaccucggcaagugcaacaucgccggguggauccugggcaacccggagugcgagagccuguccaccgccucguccuggagcuacaucguggagaccuccucguccgacaacgggacgugcuaccccggcgacuucaucgacuacgaggagcuccgggagcagcugagcuccgugucguccuucgagcgguucgagaucuuccccaagaccagcuccuggcccaaccacgacucgaacaagggcgucaccgccgccugcccgcacgccggggcgaaguccuucuacaagaaccugaucuggcucgugaagaagggcaacagcuaccccaagcuguccaagucguacaucaacgacaaggggaaggaggugcugguccucuggggcauccaccaccccagcaccuccgccgaccagcagucgcuguaccagaacgccgacgccuacguguucgugggguccagccgcuacuccaagaaguucaagcccgagaucgccauccggccgaagguccgcgaccaggagggccggaugaacuacuacuggacgcugguggagcccggcgacaagaucaccuucgaggcgaccgggaaccucguggucccccgcuacgccuucgccauggagcggaacgccggcucggggaucaucaucuccgacacccccgugcacgacugcaacacgaccugccagaccccgaagggcgccaucaacaccagccugcccuuccagaacauccaccccaucacgaucggcaagugccccaaguacgugaaguccaccaagcugcgccucgcgaccgggcugcggaacgucccgucgauccagucccgcggccuguucggggccaucgccggcuucaucgagggcggguggaccggcaugguggacgggugguacggcuaccaccaccagaacgagcaggggagcggcuacgccgccgaccucaaguccacgcagaacgcgaucgacgagaucaccaacaaggugaacucggucaucgagaagaugaacacccaguucaccgccguggggaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucggcaacgggugcuucgaguucuaccacaagugcgacaacacgugcauggaguccgugaagaacggcaccuacgacuaccccaaguacucggaggaggccaagcugaaccgcgaggagaucgacggggugaagcucgaguccacccggaucuaccagauccuggcgaucuacagcaccgucgccucgucccuggugcucguggucagccugggcgccaucuccuucuggaugugcagcaacgggucccugcagugccgcaucugcaucuga

SEQ ID NO: 3051 - RNA, 1701 nt, Artificial Sequence; identical to SEQ ID NO: 62
  derived and/or modified CDS sequence (AUadapt) from InfluenzaA__ACR18993__HA

SEQ ID NO: 3052 - RNA, 1701 nt, Artificial Sequence; identical to SEQ ID NO: 2940
  derived and/or modified CDS sequence (AUadapt) from InfluenzaA__ACR18995__HA

SEQ ID NO: 3053 - RNA, 1701 nt, Artificial Sequence; identical to SEQ ID NO: 2962
  derived and/or modified CDS sequence (AUadapt) from InfluenzaA__ACR23302__HA

SEQ ID NO: 3054 - RNA, 1701 nt, Artificial Sequence; identical to SEQ ID NO: 116
  derived and/or modified CDS sequence (AUadapt) from InfluenzaA__ACR33743__HA

SEQ ID NO: 3055 - RNA, 1701 nt, Artificial Sequence; identical to SEQ ID NO: 62
  derived and/or modified CDS sequence (AUadapt) from InfluenzaA__ACR38821__HA

SEQ ID NO: 3056 - RNA, 1701 nt, Artificial Sequence; identical to SEQ ID NO: 62
  derived and/or modified CDS sequence (AUadapt) from InfluenzaA__ACR38822__HA

SEQ ID NO: 3057 - RNA, 1701 nt, Artificial Sequence; identical to SEQ ID NO: 62
  derived and/or modified CDS sequence (AUadapt) from InfluenzaA__ACR38823__HA

SEQ ID NO: 3058 - RNA, 1701 nt, Artificial Sequence; identical to SEQ ID NO: 2967
  derived and/or modified CDS sequence (AUadapt) from InfluenzaA__ACR38824__HA

SEQ ID NO: 3059 - RNA, 1701 nt, Artificial Sequence
  derived and/or modified CDS sequence (AUadapt) from InfluenzaA__ACR38825__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccggggccaggaggggcgcaugaacuacuacuggacccugguggagcccggcgacaagaucaccuucgaggcgaccgggaaccucguggucccccgguacgccuucgccauggagcgcaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagucgaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaagaucgacgacggguuccucgacaucuggaccuacaacgccgagcugcugguccuccuggagaacgagcggacccuggacuaccacgacagcaacgugaagaaccucuacgagaaggugcgcucccagcugaagaacaacgccaaggagaucggcaacgggugcuucgaguucuaccacaagugcgacaacacgugcauggagucggucaagaacggcaccuacgacuaccccaaguacuccgaggaggccaagcugaaccgggaggagaucgacggggugaagcucgagagcacccgcaucuaccagauccuggcgaucuacuccaccguggccucgagccugguccucguggugucccugggcgccaucucguucuggaugugcuccaacggcagccugcagugccggaucugcaucuga

SEQ ID NO: 3060 - RNA, 1701 nt, Artificial Sequence; identical to SEQ ID NO: 116
  derived and/or modified CDS sequence (AUadapt) from InfluenzaA__ACR38826__HA

SEQ ID NO: 3061 - RNA, 1701 nt, Artificial Sequence; identical to SEQ ID NO: 62
  derived and/or modified CDS sequence (AUadapt) from InfluenzaA__ACR38827__HA

SEQ ID NO: 3062 - RNA, 1701 nt, Artificial Sequence; identical to SEQ ID NO: 2967
  derived and/or modified CDS sequence (AUadapt) from InfluenzaA__ACR38828__HA

SEQ ID NO: 3063 - RNA, 1701 nt, Artificial Sequence; identical to SEQ ID NO: 62
  derived and/or modified CDS sequence (AUadapt) from InfluenzaA__ACR38829__HA

SEQ ID NO: 3064 - RNA, 1701 nt, Artificial Sequence; identical to SEQ ID NO: 2940
  derived and/or modified CDS sequence (AUadapt) from InfluenzaA__ACR38830__HA

SEQ ID NO: 3065 - RNA, 1701 nt, Artificial Sequence; identical to SEQ ID NO: 116
  derived and/or modified CDS sequence (AUadapt) from InfluenzaA__ACR39354__HA

SEQ ID NO: 3066 - RNA, 1701 nt, Artificial Sequence; identical to SEQ ID NO: 116
  derived and/or modified CDS sequence (AUadapt) from InfluenzaA__ACR39393__HA

SEQ ID NO: 3067 - RNA, 1701 nt, Artificial Sequence; identical to SEQ ID NO: 116
  derived and/or modified CDS sequence (AUadapt) from InfluenzaA__ACR39403__HA

SEQ ID NO: 3068 - RNA, 1701 nt, Artificial Sequence; identical to SEQ ID NO: 116
  derived and/or modified CDS sequence (AUadapt) from InfluenzaA__ACR39413__HA

SEQ ID NO: 3069 - RNA, 1701 nt, Artificial Sequence; identical to SEQ ID NO: 116
  derived and/or modified CDS sequence (AUadapt) from InfluenzaA__ACR39423__HA

SEQ ID NO: 3070 - RNA, 1701 nt, Artificial Sequence; identical to SEQ ID NO: 116
  derived and/or modified CDS sequence (AUadapt) from InfluenzaA__ACR39433__HA

SEQ ID NO: 3071 - RNA, 1701 nt, Artificial Sequence; identical to SEQ ID NO: 116
  derived and/or modified CDS sequence (AUadapt) from InfluenzaA__ACR39443__HA

SEQ ID NO: 3072 - RNA, 1701 nt, Artificial Sequence
  derived and/or modified CDS sequence (AUadapt) from InfluenzaA__ACR39453__HA
auggaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 3073 - RNA, 1701 nt, Artificial Sequence; identical to SEQ ID NO: 116
  derived and/or modified CDS sequence (AUadapt) from InfluenzaA__ACR39463__HA

SEQ ID NO: 3074 - RNA, 1701 nt, Artificial Sequence; identical to SEQ ID NO: 116
  derived and/or modified CDS sequence (AUadapt) from InfluenzaA__ACR39473__HA

SEQ ID NO: 3075 - RNA, 1701 nt, Artificial Sequence; identical to SEQ ID NO: 116
  derived and/or modified CDS sequence (AUadapt) from InfluenzaA__ACR39483__HA

SEQ ID NO: 3076 - RNA, 1701 nt, Artificial Sequence; identical to SEQ ID NO: 116
  derived and/or modified CDS sequence (AUadapt) from InfluenzaA__ACR39493__HA

SEQ ID NO: 3077 - RNA, 1701 nt, Artificial Sequence; identical to SEQ ID NO: 116
  derived and/or modified CDS sequence (AUadapt) from InfluenzaA__ACR40288__HA

SEQ ID NO: 3078 - RNA, 1701 nt, Artificial Sequence; identical to SEQ ID NO: 116
  derived and/or modified CDS sequence (AUadapt) from InfluenzaA__ACR40298__HA

SEQ ID NO: 3079 - RNA, 1701 nt, Artificial Sequence
  derived and/or modified CDS sequence (AUadapt) from InfluenzaA__ACR40308__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcuccucgcgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccucgcugcccuuccagaacaucuaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 3080 - RNA, 1701 nt, Artificial Sequence; identical to SEQ ID NO: 116
  derived and/or modified CDS sequence (AUadapt) from InfluenzaA__ACR40318__HA

SEQ ID NO: 3081 - RNA, 1701 nt, Artificial Sequence; identical to SEQ ID NO: 116
  derived and/or modified CDS sequence (AUadapt) from InfluenzaA__ACR40328__HA

SEQ ID NO: 3082 - RNA, 1701 nt, Artificial Sequence; identical to SEQ ID NO: 116
  derived and/or modified CDS sequence (AUadapt) from InfluenzaA__ACR40338__HA

SEQ ID NO: 3083 - RNA, 1701 nt, Artificial Sequence; identical to SEQ ID NO: 116
  derived and/or modified CDS sequence (AUadapt) from InfluenzaA__ACR40348__HA

SEQ ID NO: 3084 - RNA, 1701 nt, Artificial Sequence; identical to SEQ ID NO: 116
  derived and/or modified CDS sequence (AUadapt) from InfluenzaA__ACR40358__HA

SEQ ID NO: 3085 - RNA, 1701 nt, Artificial Sequence; identical to SEQ ID NO: 116
  derived and/or modified CDS sequence (AUadapt) from InfluenzaA__ACR40378__HA

SEQ ID NO: 3086 - RNA, 1701 nt, Artificial Sequence; identical to SEQ ID NO: 116
  derived and/or modified CDS sequence (AUadapt) from InfluenzaA__ACR40388__HA

SEQ ID NO: 3087 - RNA, 1701 nt, Artificial Sequence; identical to SEQ ID NO: 62
  derived and/or modified CDS sequence (AUadapt) from InfluenzaA__ACR46986__HA

SEQ ID NO: 3088 - RNA, 1701 nt, Artificial Sequence; identical to SEQ ID NO: 62
  derived and/or modified CDS sequence (AUadapt) from InfluenzaA__ACR46988__HA

SEQ ID NO: 3089 - RNA, 1701 nt, Artificial Sequence; identical to SEQ ID NO: 62
  derived and/or modified CDS sequence (AUadapt) from InfluenzaA__ACR46989__HA

SEQ ID NO: 3090 - RNA, 1701 nt, Artificial Sequence; identical to SEQ ID NO: 62
  derived and/or modified CDS sequence (AUadapt) from InfluenzaA__ACR46990__HA

SEQ ID NO: 3091 - RNA, 1701 nt, Artificial Sequence; identical to SEQ ID NO: 62
  derived and/or modified CDS sequence (AUadapt) from InfluenzaA__ACR46992__HA

SEQ ID NO: 3092 - RNA, 1701 nt, Artificial Sequence; identical to SEQ ID NO: 62
  derived and/or modified CDS sequence (AUadapt) from InfluenzaA__ACR46993__HA

SEQ ID NO: 3093 - RNA, 1701 nt, Artificial Sequence; identical to SEQ ID NO: 62
  derived and/or modified CDS sequence (AUadapt) from InfluenzaA__ACR46994__HA

SEQ ID NO: 3094 - RNA, 1701 nt, Artificial Sequence; identical to SEQ ID NO: 96
  derived and/or modified CDS sequence (AUadapt) from InfluenzaA__ACR47006__HA

SEQ ID NO: 3095 - RNA, 1701 nt, Artificial Sequence; identical to SEQ ID NO: 116
  derived and/or modified CDS sequence (AUadapt) from InfluenzaA__ACR49281__HA

SEQ ID NO: 3096 - RNA, 1701 nt, Artificial Sequence
  derived and/or modified CDS sequence (AUadapt) from InfluenzaA__ACR49282__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccguggaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 3097 - RNA, 1701 nt, Artificial Sequence; identical to SEQ ID NO: 62
  derived and/or modified CDS sequence (AUadapt) from InfluenzaA__ACR49283__HA

SEQ ID NO: 3098 - RNA, 1701 nt, Artificial Sequence; identical to SEQ ID NO: 62
  derived and/or modified CDS sequence (AUadapt) from InfluenzaA__ACR49288__HA

SEQ ID NO: 3099 - RNA, 1701 nt, Artificial Sequence; identical to SEQ ID NO: 2940
  derived and/or modified CDS sequence (AUadapt) from InfluenzaA__ACR49290__HA

SEQ ID NO: 3100 - RNA, 1701 nt, Artificial Sequence; identical to SEQ ID NO: 116
  derived and/or modified CDS sequence (AUadapt) from InfluenzaA__ACR49291__HA

SEQ ID NO: 3101 - RNA, 1701 nt, Artificial Sequence; identical to SEQ ID NO: 2940
  derived and/or modified CDS sequence (AUadapt) from InfluenzaA__ACR49293__HA

SEQ ID NO: 3102 - RNA, 1701 nt, Artificial Sequence; identical to SEQ ID NO: 2940
  derived and/or modified CDS sequence (AUadapt) from InfluenzaA__ACR49295__HA

SEQ ID NO: 3103 - RNA, 1701 nt, Artificial Sequence; identical to SEQ ID NO: 2954
  derived and/or modified CDS sequence (AUadapt) from InfluenzaA__ACR50993__HA

SEQ ID NO: 3104 - RNA, 1701 nt, Artificial Sequence; identical to SEQ ID NO: 116
  derived and/or modified CDS sequence (AUadapt) from InfluenzaA__ACR50995__HA

SEQ ID NO: 3105 - RNA, 1701 nt, Artificial Sequence; identical to SEQ ID NO: 116
  derived and/or modified CDS sequence (AUadapt) from InfluenzaA__ACR51005__HA

SEQ ID NO: 3106 - RNA, 1701 nt, Artificial Sequence; identical to SEQ ID NO: 116
  derived and/or modified CDS sequence (AUadapt) from InfluenzaA__ACR51015__HA

SEQ ID NO: 3107 - RNA, 1701 nt, Artificial Sequence; identical to SEQ ID NO: 116
  derived and/or modified CDS sequence (AUadapt) from InfluenzaA__ACR51025__HA

SEQ ID NO: 3108 - RNA, 1701 nt, Artificial Sequence; identical to SEQ ID NO: 116
  derived and/or modified CDS sequence (AUadapt) from InfluenzaA__ACR51035__HA

SEQ ID NO: 3109 - RNA, 1701 nt, Artificial Sequence; identical to SEQ ID NO: 116
  derived and/or modified CDS sequence (AUadapt) from InfluenzaA__ACR51045__HA

SEQ ID NO: 3110 - RNA, 1701 nt, Artificial Sequence; identical to SEQ ID NO: 116
  derived and/or modified CDS sequence (AUadapt) from InfluenzaA__ACR51055__HA

SEQ ID NO: 3111 - RNA, 1701 nt, Artificial Sequence; identical to SEQ ID NO: 62
  derived and/or modified CDS sequence (AUadapt) from InfluenzaA__ACR51065__HA

SEQ ID NO: 3112 - RNA, 1701 nt, Artificial Sequence; identical to SEQ ID NO: 116
  derived and/or modified CDS sequence (AUadapt) from InfluenzaA__ACR52368__HA

SEQ ID NO: 3113 - RNA, 1701 nt, Artificial Sequence; identical to SEQ ID NO: 116
  derived and/or modified CDS sequence (AUadapt) from InfluenzaA__ACR52378__HA

SEQ ID NO: 3114 - RNA, 1701 nt, Artificial Sequence; identical to SEQ ID NO: 116
  derived and/or modified CDS sequence (AUadapt) from InfluenzaA__ACR52398__HA

SEQ ID NO: 3115 - RNA, 1701 nt, Artificial Sequence; identical to SEQ ID NO: 116
  derived and/or modified CDS sequence (AUadapt) from InfluenzaA__ACR52408__HA

SEQ ID NO: 3116 - RNA, 1701 nt, Artificial Sequence; identical to SEQ ID NO: 116
  derived and/or modified CDS sequence (AUadapt) from InfluenzaA__ACR52418__HA

SEQ ID NO: 3117 - RNA, 1701 nt, Artificial Sequence; identical to SEQ ID NO: 116
  derived and/or modified CDS sequence (AUadapt) from InfluenzaA__ACR52428__HA

SEQ ID NO: 3118 - RNA, 1701 nt, Artificial Sequence; identical to SEQ ID NO: 116
  derived and/or modified CDS sequence (AUadapt) from InfluenzaA__ACR52438__HA

SEQ ID NO: 3119 - RNA, 1701 nt, Artificial Sequence; identical to SEQ ID NO: 116
  derived and/or modified CDS sequence (AUadapt) from InfluenzaA__ACR52448__HA

SEQ ID NO: 3120 - RNA, 1701 nt, Artificial Sequence; identical to SEQ ID NO: 116
  derived and/or modified CDS sequence (AUadapt) from InfluenzaA__ACR52458__HA

SEQ ID NO: 3121 - RNA, 1701 nt, Artificial Sequence; identical to SEQ ID NO: 116
  derived and/or modified CDS sequence (AUadapt) from InfluenzaA__ACR52468__HA

SEQ ID NO: 3122 - RNA, 1701 nt, Artificial Sequence; identical to SEQ ID NO: 116
  derived and/or modified CDS sequence (AUadapt) from InfluenzaA__ACR52478__HA

SEQ ID NO: 3123 - RNA, 1701 nt, Artificial Sequence; identical to SEQ ID NO: 116
  derived and/or modified CDS sequence (AUadapt) from InfluenzaA__ACR52488__HA

SEQ ID NO: 3124 - RNA, 1701 nt, Artificial Sequence; identical to SEQ ID NO: 116
  derived and/or modified CDS sequence (AUadapt) from InfluenzaA__ACR54045__HA

SEQ ID NO: 3125 - RNA, 1701 nt, Artificial Sequence
  derived and/or modified CDS sequence (AUadapt) from InfluenzaA__ACR54047__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcaucaagcucgaguccacccgcaucuaccagauccuggcgaucuacagcaccguggccucgucccugguccucguggugagccugggggccaucuccuucuggaugugcagcaacggcucccugcagugccggaucugcaucuga

SEQ ID NO: 3126 - RNA, 1701 nt, Artificial Sequence
  derived and/or modified CDS sequence (AUadapt) from InfluenzaA__ACR54964__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucaucgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgacccgcaucuaccagauccuggcgaucuacuccaccgucgccagcucgcuggugcucguggucucccugggggccaucagcuucuggaugugcuccaacggcagccugcagugccggaucugcaucuga

SEQ ID NO: 3127 - RNA, 1701 nt, Artificial Sequence; identical to SEQ ID NO: 3005
  derived and/or modified CDS sequence (AUadapt) from InfluenzaA__ACR54974__HA

SEQ ID NO: 3128 - RNA, 1701 nt, Artificial Sequence; identical to SEQ ID NO: 116
  derived and/or modified CDS sequence (AUadapt) from InfluenzaA__ACR54984__HA

SEQ ID NO: 3129 - RNA, 1701 nt, Artificial Sequence; identical to SEQ ID NO: 62
  derived and/or modified CDS sequence (AUadapt) from InfluenzaA__ACR54994__HA

SEQ ID NO: 3130 - RNA, 1701 nt, Artificial Sequence; identical to SEQ ID NO: 62
  derived and/or modified CDS sequence (AUadapt) from InfluenzaA__ACR55004__HA

SEQ ID NO: 3131 - RNA, 1701 nt, Artificial Sequence; identical to SEQ ID NO: 96
  derived and/or modified CDS sequence (AUadapt) from InfluenzaA__ACR56380__HA

SEQ ID NO: 3132 - RNA, 1701 nt, Artificial Sequence; identical to SEQ ID NO: 2967
  derived and/or modified CDS sequence (AUadapt) from InfluenzaA__ACR56390__HA

SEQ ID NO: 3133 - RNA, 1701 nt, Artificial Sequence; identical to SEQ ID NO: 116
  derived and/or modified CDS sequence (AUadapt) from InfluenzaA__ACR56400__HA

SEQ ID NO: 3134 - RNA, 1701 nt, Artificial Sequence; identical to SEQ ID NO: 116
  derived and/or modified CDS sequence (AUadapt) from InfluenzaA__ACR56410__HA

SEQ ID NO: 3135 - RNA, 1701 nt, Artificial Sequence; identical to SEQ ID NO: 116
  derived and/or modified CDS sequence (AUadapt) from InfluenzaA__ACR56420__HA

SEQ ID NO: 3136 - RNA, 1701 nt, Artificial Sequence; identical to SEQ ID NO: 116
  derived and/or modified CDS sequence (AUadapt) from InfluenzaA__ACR56430__HA

SEQ ID NO: 3137 - RNA, 1701 nt, Artificial Sequence; identical to SEQ ID NO: 116
  derived and/or modified CDS sequence (AUadapt) from InfluenzaA__ACR56440__HA

SEQ ID NO: 3138 - RNA, 1698 nt, Artificial Sequence
  derived and/or modified CDS sequence (AUadapt) from InfluenzaA__ACR58541__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccggcguguccgccucgugcucccacaacggcgagagcuccuucuaccgcaaccugcuguggcucacccggaagaacgggcuguaccccaaccugagcaaguccuacgccaacaacaaggagaaggaggugcucguccuguggggcgugcaccacccgcccaacaucggggaccagaaggcccuguaccacaccgagaacgccuacgugucggucgugagcucccacuacagccgcaaguucacgcccgagaucgccaagcggcccaaggugcgcgaccaggagggccggaucaacuacuacuggacccuccuggagcccggcgacaccaucaucuucgaggcgaacgggaaccugaucgccccgcgcuacgccuucgcccucucccggggcuucgggagcggcaucaucaacuccaacgcccccauggacaagugcgacgcgaagugccagacgccccagggcgccaucaacucgucccugcccuuccagaacguccacccggugaccaucggggagugccccaaguacgugcgcagcgccaagcugcggauggucaccggccuccgcaacauccccuccauccagagccgggggcuguucggcgccaucgccggguucaucgagggcggcuggaccgggaugguggacggcugguacggguaccaccaccagaacgagcagggcuccggguacgcggccgaccagaaguccacccagaacgccaucaacggcaucacgaacaaggugaacucggucaucgacaagaugaacacccaguucaccgccgugggcaaggaguucaacaagcuggagcgccggauggagaaccucaacaagaaggucgacgacggguucaucgacaucuggaccuacaacgccgagcugcuggugcuccuggagaacgagcgcacgcuggacuuccacgacagcaacgugaagaaccucuacgagaaggucaagucccagcugaagaacaacgcgaaggagaucggcaacgggugcuucgaguucuaccacaagugcaacgacgagugcauggagagcgugaagaacggcaccuacgacuaccccaaguacuccgaggagagcaagcugaaccgggagaagaucgacggggugaagcucgaguccaugggcgucuaccagauccuggccaucuacucgaccguggccagcucccuggugcuccuggucagccugggcgccaucuccuucuggaugugcagcaacgggucccuccagugccgcaucugcaucuga

SEQ ID NO: 3139 - RNA, 1698 nt, Artificial Sequence; identical to SEQ ID NO: 2159
  derived and/or modified CDS sequence (AUadapt) from InfluenzaA__ACR61655__HA

SEQ ID NO: 3140 - RNA, 1698 nt, Artificial Sequence; identical to SEQ ID NO: 2175
  derived and/or modified CDS sequence (AUadapt) from InfluenzaA__ACR61666__HA

SEQ ID NO: 3141 - RNA, 1701 nt, Artificial Sequence; identical to SEQ ID NO: 2679
  derived and/or modified CDS sequence (AUadapt) from InfluenzaA__ACR61677__HA

SEQ ID NO: 3142 - RNA, 1701 nt, Artificial Sequence; identical to SEQ ID NO: 2679
  derived and/or modified CDS sequence (AUadapt) from InfluenzaA__ACR61688__HA

SEQ ID NO: 3143 - RNA, 1701 nt, Artificial Sequence; identical to SEQ ID NO: 2679
  derived and/or modified CDS sequence (AUadapt) from InfluenzaA__ACR61699__HA

SEQ ID NO: 3144 - RNA, 1701 nt, Artificial Sequence; identical to SEQ ID NO: 62
  derived and/or modified CDS sequence (AUadapt) from InfluenzaA__ACR67170__HA

SEQ ID NO: 3145 - RNA, 1701 nt, Artificial Sequence; identical to SEQ ID NO: 2940
  derived and/or modified CDS sequence (AUadapt) from InfluenzaA__ACR67171__HA

SEQ ID NO: 3146 - RNA, 1701 nt, Artificial Sequence; identical to SEQ ID NO: 62
  derived and/or modified CDS sequence (AUadapt) from InfluenzaA__ACR67172__HA

SEQ ID NO: 3147 - RNA, 1701 nt, Artificial Sequence; identical to SEQ ID NO: 62
  derived and/or modified CDS sequence (AUadapt) from InfluenzaA__ACR67177__HA

SEQ ID NO: 3148 - RNA, 1701 nt, Artificial Sequence; identical to SEQ ID NO: 62
  derived and/or modified CDS sequence (AUadapt) from InfluenzaA__ACR67181__HA

SEQ ID NO: 3149 - RNA, 1701 nt, Artificial Sequence; identical to SEQ ID NO: 137
  derived and/or modified CDS sequence (AUadapt) from InfluenzaA__ACR67183__HA

SEQ ID NO: 3150 - RNA, 1701 nt, Artificial Sequence; identical to SEQ ID NO: 116
  derived and/or modified CDS sequence (AUadapt) from InfluenzaA__ACR67184__HA

SEQ ID NO: 3151 - RNA, 1701 nt, Artificial Sequence; identical to SEQ ID NO: 62
  derived and/or modified CDS sequence (AUadapt) from InfluenzaA__ACR67185__HA

SEQ ID NO: 3152 - RNA, 1701 nt, Artificial Sequence; identical to SEQ ID NO: 96
  derived and/or modified CDS sequence (AUadapt) from InfluenzaA__ACR67186__HA

SEQ ID NO: 3153 - RNA, 1701 nt, Artificial Sequence; identical to SEQ ID NO: 62
  derived and/or modified CDS sequence (AUadapt) from InfluenzaA__ACR67187__HA

SEQ ID NO: 3154 - RNA, 1701 nt, Artificial Sequence; identical to SEQ ID NO: 2940
  derived and/or modified CDS sequence (AUadapt) from InfluenzaA__ACR67188__HA

SEQ ID NO: 3155 - RNA, 1701 nt, Artificial Sequence; identical to SEQ ID NO: 2940
  derived and/or modified CDS sequence (AUadapt) from InfluenzaA__ACR67189__HA

SEQ ID NO: 3156 - RNA, 1701 nt, Artificial Sequence
  derived and/or modified CDS sequence (AUadapt) from InfluenzaA__ACR67190__HA
auggaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccacaacauccaccccaucacgaucgggaagugccccaaguacgugaaguccaccaagcugcggcucgcgaccggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 3157 - RNA, 1701 nt, Artificial Sequence; identical to SEQ ID NO: 62
  derived and/or modified CDS sequence (AUadapt) from InfluenzaA__ACR67192__HA

SEQ ID NO: 3158 - RNA, 1701 nt, Artificial Sequence
  derived and/or modified CDS sequence (AUadapt) from InfluenzaA__ACR67193__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccucguccuggagcuacaucguggagaccuccucguccgacaacggcacgugcuaccccggcgacuucaucgacuacgaggagcugcgggagcagcucagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcuggugaagaaggggaacagcuaccccaagcucuccaagucguacaucaacgacaagggcaaggaggugcugguccugugggggauccaccaccccagcaccuccgccgaccagcagucgcucuaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggucgggcaucaucaucuccgacacccccgugcacgagugcaacacgaccugccagaccccgaagggcgccaucaacaccagccuccccuuccagaacauccaccccaucacgaucgggaagugccccaaguacgugaaguccaccaagcugcggcuggcgaccggccuccgcaacgucccgucgauccagucccgggggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacucggucaucgagaagaugaacacccaguucaccgccgugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcuggaguccacccgcaucuaccagauccucgcgaucuacagcaccgucgccucgucccuggugcugguggucagccucggggccaucuccuucuggaugugcagcaacggcucccugcagugccggaucugcaucuga

SEQ ID NO: 3159 - RNA, 1701 nt, Artificial Sequence; identical to SEQ ID NO: 62
  derived and/or modified CDS sequence (AUadapt) from InfluenzaA__ACR67195__HA

SEQ ID NO: 3160 - RNA, 1701 nt, Artificial Sequence; identical to SEQ ID NO: 62
  derived and/or modified CDS sequence (AUadapt) from InfluenzaA__ACR67197__HA

SEQ ID NO: 3161 - RNA, 1701 nt, Artificial Sequence; identical to SEQ ID NO: 3158
  derived and/or modified CDS sequence (AUadapt) from InfluenzaA__ACR67198__HA

SEQ ID NO: 3162 - RNA, 1701 nt, Artificial Sequence; identical to SEQ ID NO: 62
  derived and/or modified CDS sequence (AUadapt) from InfluenzaA__ACR67199__HA

SEQ ID NO: 3163 - RNA, 1701 nt, Artificial Sequence; identical to SEQ ID NO: 116
  derived and/or modified CDS sequence (AUadapt) from InfluenzaA__ACR67244__HA

SEQ ID NO: 3164 - RNA, 1701 nt, Artificial Sequence
  derived and/or modified CDS sequence (AUadapt) from InfluenzaA__ACR67254__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcuccucgcgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacguggggagcggcaucaucaucuccgacacccccgugcacgacugcaacacgaccugccagaccccgaagggcgccaucaacaccucgcugcccuuccagaacauccaccccaucacgaucgggaagugccccaaguacgucaaguccaccaagcugcggcucgccaccggccugcgcaacgugccgagcauccagucccgggggcuguucggcgcgaucgccggguucaucgagggcggcuggaccgggaugguggacggcugguacggguaccaccaccagaacgagcagggcagcggguacgccgccgaccucaaguccacgcagaacgccaucgacgagaucaccaacaaggucaacucggugaucgagaagaugaacacccaguucaccgcggucggcaaggaguucaaccaccuggagaagcgcaucgagaaccugaacaagaagguggacgacggcuuccucgacaucuggacguacaacgccgagcugcuggugcuccuggagaacgagcggacccuggacuaccacgacuccaacgucaagaaccucuacgagaaggugcgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgucaagcucgaguccacccgcaucuaccagauccuggccaucuacagcaccguggcgucgucccuggugcucgucgugagccugggggccaucuccuucuggaugugcagcaacggcucccugcagugccggaucugcaucuga

SEQ ID NO: 3165 - RNA, 1701 nt, Artificial Sequence; identical to SEQ ID NO: 116
  derived and/or modified CDS sequence (AUadapt) from InfluenzaA__ACR77438__HA

SEQ ID NO: 3166 - RNA, 1701 nt, Artificial Sequence; identical to SEQ ID NO: 116
  derived and/or modified CDS sequence (AUadapt) from InfluenzaA__ACR77448__HA

SEQ ID NO: 3167 - RNA, 1701 nt, Artificial Sequence
  derived and/or modified CDS sequence (AUadapt) from InfluenzaA__ACR77458__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgacaagugcaacaucgccggguggauccugggcaacccggagugcgagucgcuguccaccgccagcuccuggucguacaucguggagaccuccagcuccgacaacgggacgugcuaccccggcgacuucaucgacuacgaggagcuccgggagcagcugucguccgugagcuccuucgagcgcuucgagaucuuccccaagaccucguccuggcccaaccacgacagcaacaagggcgucaccgccgccugcccgcacgccggggcgaaguccuucuacaagaaccugaucuggcucgugaagaagggcaacucguaccccaagcuguccaagagcuacaucaacgacaaggggaaggaggugcugguccucuggggcauccaccaccccucgaccuccgccgaccagcagagccuguaccagaacgccgacgccuacguguucguggggacgucccgguacucgaagaaguucaagcccgagaucgccauccgcccgaagguccgggaccaggagggccgcaugaacuacuacuggacccugguggagcccggcgacaagaucaccuucgaggcgaccgggaaccucguggucccccgguacgccuucgccauggagcgcaacgccggcuccgggaucaucaucagcgacacgcccgugcacgacugcaacacgaccugccagaccccgaagggcgccaucaacaccucccugcccuuccagaacauccaccccaucaccaucggcaagugccccaaguacgucaagucgaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagucgacccagaacgcgaucgacgagaucaccaacaaggugaacuccgucaucgagaagaugaacacccaguucacggccguggggaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcucgagagcacccgcaucuaccagauccuggcgaucuacuccaccgucgccucgagccuggugcucguggucucccugggcgccaucucguucuggaugugcuccaacgggagccugcagugccggaucugcaucuga

SEQ ID NO: 3168 - RNA, 1701 nt, Artificial Sequence; identical to SEQ ID NO: 116
  derived and/or modified CDS sequence (AUadapt) from InfluenzaA__ACR77468__HA

SEQ ID NO: 3169 - RNA, 1701 nt, Artificial Sequence; identical to SEQ ID NO: 116
  derived and/or modified CDS sequence (AUadapt) from InfluenzaA__ACR77478__HA

SEQ ID NO: 3170 - RNA, 1701 nt, Artificial Sequence; identical to SEQ ID NO: 116
  derived and/or modified CDS sequence (AUadapt) from InfluenzaA__ACR77488__HA

SEQ ID NO: 3171 - RNA, 1701 nt, Artificial Sequence; identical to SEQ ID NO: 116
  derived and/or modified CDS sequence (AUadapt) from InfluenzaA__ACR77498__HA

SEQ ID NO: 3172 - RNA, 1701 nt, Artificial Sequence; identical to SEQ ID NO: 62
  derived and/or modified CDS sequence (AUadapt) from InfluenzaA__ACR83525__HA

SEQ ID NO: 3173 - RNA, 1701 nt, Artificial Sequence
  derived and/or modified CDS sequence (AUadapt) from InfluenzaA__ACR83538__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccugucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacucgaacgugaagaaccuguacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcucaaccgggaggagaucgacggcgugaagcuggagucgacccgcaucuaccagauccuggcgaucuacuccaccgucgccagcucgcucgugcugguggucucccugggggccaucagcuucuggaugugcuccaacggcagccuccagugccggaucugcaucuga

SEQ ID NO: 3174 - RNA, 1701 nt, Artificial Sequence; identical to SEQ ID NO: 116
  derived and/or modified CDS sequence (AUadapt) from InfluenzaA__ACS14666__HA

SEQ ID NO: 3175 - RNA, 1701 nt, Artificial Sequence; identical to SEQ ID NO: 116
  derived and/or modified CDS sequence (AUadapt) from InfluenzaA__ACS14676__HA

SEQ ID NO: 3176 - RNA, 1701 nt, Artificial Sequence; identical to SEQ ID NO: 116
  derived and/or modified CDS sequence (AUadapt) from InfluenzaA__ACS14686__HA

SEQ ID NO: 3177 - RNA, 1701 nt, Artificial Sequence; identical to SEQ ID NO: 116
  derived and/or modified CDS sequence (AUadapt) from InfluenzaA__ACS14696__HA

SEQ ID NO: 3178 - RNA, 1701 nt, Artificial Sequence; identical to SEQ ID NO: 116
  derived and/or modified CDS sequence (AUadapt) from InfluenzaA__ACS14706__HA

SEQ ID NO: 3179 - RNA, 1701 nt, Artificial Sequence; identical to SEQ ID NO: 116
  derived and/or modified CDS sequence (AUadapt) from InfluenzaA__ACS14716__HA

SEQ ID NO: 3180 - RNA, 1701 nt, Artificial Sequence; identical to SEQ ID NO: 116
  derived and/or modified CDS sequence (AUadapt) from InfluenzaA__ACS14726__HA

SEQ ID NO: 3181 - RNA, 1701 nt, Artificial Sequence; identical to SEQ ID NO: 116
  derived and/or modified CDS sequence (AUadapt) from InfluenzaA__ACS14736__HA

SEQ ID NO: 3182 - RNA, 1701 nt, Artificial Sequence; identical to SEQ ID NO: 96
  derived and/or modified CDS sequence (AUadapt) from InfluenzaA__ACS27189__HA

SEQ ID NO: 3183 - RNA, 1701 nt, Artificial Sequence; identical to SEQ ID NO: 116
  derived and/or modified CDS sequence (AUadapt) from InfluenzaA__ACS27199__HA

SEQ ID NO: 3184 - RNA, 1701 nt, Artificial Sequence; identical to SEQ ID NO: 116
  derived and/or modified CDS sequence (AUadapt) from InfluenzaA__ACS27209__HA

SEQ ID NO: 3185 - RNA, 1701 nt, Artificial Sequence; identical to SEQ ID NO: 2967
  derived and/or modified CDS sequence (AUadapt) from InfluenzaA__ACS27219__HA

SEQ ID NO: 3186 - RNA, 1701 nt, Artificial Sequence; identical to SEQ ID NO: 116
  derived and/or modified CDS sequence (AUadapt) from InfluenzaA__ACS27229__HA

SEQ ID NO: 3187 - RNA, 1701 nt, Artificial Sequence
  derived and/or modified CDS sequence (AUadapt) from InfluenzaA__ACS27239__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccaugucguccuucgagcgcuucgagaucuuccccaagaccagcuccuggcccaaccacgacucgaacaagggggugaccgccgccugcccgcacgccggcgcgaaguccuucuacaagaaccugaucuggcucgucaagaaggggaacagcuaccccaagcuguccaagucguacaucaacgacaagggcaaggaggugcuggugcucugggggauccaccaccccagcaccuccgccgaccagcagucgcuguaccagaacgccgacgccuacgucuucgugggcuccagccgguacuccaagaaguucaagcccgagaucgccauccgcccgaaggugcgggaccaggagggccgcaugaacuacuacuggacgcuggucgagcccggggacaagaucaccuucgaggcgaccggcaaccucguggugccccgguacgccuucgccauggagcgcaacgccgggucgggcaucaucaucuccgacacccccguccacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgugccgucgauccagucccgggggcuguucggcgccaucgccggguucaucgagggcggcuggaccgggauggucgacggcugguacggguaccaccaccagaacgagcagggcagcggguacgccgccgaccucaaguccacgcagaacgcgaucgacgagaucaccaacaaggugaacucggugaucgagaagaugaacacccaguucaccgccgucggcaaggaguucaaccaccuggagaagcgcaucgagaaccugaacaagaagguggacgacggcuuccucgacaucuggacguacaacgccgagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuaccccaaguacucggaggaggccaagcugaaccgggaggagaucgacggcgugaagcucgaguccacccgcaucuaccagauccuggcgaucuacagcaccguggccucgucccugguccucguggugagccugggggccaucuccuucuggaugugcagcaacggcucccugcagugccggaucugcaucuga

SEQ ID NO: 3188 - RNA, 1701 nt, Artificial Sequence; identical to SEQ ID NO: 116
  derived and/or modified CDS sequence (AUadapt) from InfluenzaA__ACS27249__HA

SEQ ID NO: 3189 - RNA, 1701 nt, Artificial Sequence; identical to SEQ ID NO: 116
  derived and/or modified CDS sequence (AUadapt) from InfluenzaA__ACS27775__HA

SEQ ID NO: 3190 - RNA, 1701 nt, Artificial Sequence; identical to SEQ ID NO: 62
  derived and/or modified CDS sequence (AUadapt) from InfluenzaA__ACS34705__HA

SEQ ID NO: 3191 - RNA, 1701 nt, Artificial Sequence; identical to SEQ ID NO: 62
  derived and/or modified CDS sequence (AUadapt) from InfluenzaA__ACS34966__HA

SEQ ID NO: 3192 - RNA, 1701 nt, Artificial Sequence
  derived and/or modified CDS sequence (AUadapt) from InfluenzaA__ACS34967__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagucgcggcuggcgaccggccuccgcaacgucccguccauccagagccgggggcuguucggcgccaucgccggguucaucgagggcggcuggaccgggaugguggacggcugguacggguaccaccaccagaacgagcagggcuccggguacgccgccgaccucaagucgacgcagaaggcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccuggacaucuggacguacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcuggagagcacccgcaucuaccagauccucgcgaucuacucgaccgucgccuccagccuggugcugguggucucccucggggccaucucguucuggaugugcuccaacggcagccugcagugccggaucugcaucuga

SEQ ID NO: 3193 - RNA, 1701 nt, Artificial Sequence
  derived and/or modified CDS sequence (AUadapt) from InfluenzaA__ACS34968__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgucguccuggagcuacaucguggaguccucguccagcgacaacgggaccugcuaccccggcgacuucaucgacuacgaggagcuccgggagcagcuguccagcguguccucguucgagcgcuucgagaucuuccccaagacguccagcuggcccaaccacgacuccaacaagggcgucaccgccgccugcccgcacgccggcgccaagucguucuacaagaaccugaucuggcucgugaagaaggggaacuccuaccccaagcugagcaagucguacaucaacgacaagggcaaggaggugcugguccucugggggauccaccaccccuccaccagcgccgaccagcagucccuguaccagaacgccgacgccuacguguucgugggcagcucccgguacucgaagaaguucaagcccgagaucgccauccgcccgaagguccgggaccaggagggccgcaugaacuacuacuggacccugguggagcccggggacaagaucaucuucgaggcgacgggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcggcucgcgacgggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagucgacccagaacgcgaucgacgagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgacccgcaucuaccagauccuggcgaucuacagcaccgucgccuccucgcuggugcucguggucucccugggggccaucagcuucuggaugugcuccaacggcagccugcagugccggaucugcaucuga

SEQ ID NO: 3194 - RNA, 1701 nt, Artificial Sequence
  derived and/or modified CDS sequence (AUadapt) from InfluenzaA__ACS36632__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacgcagaaggcgaucgacgagaucaccaacaaggugaacucggucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 3195 - RNA, 1701 nt, Artificial Sequence
  derived and/or modified CDS sequence (AUadapt) from InfluenzaA__ACS36645__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcaccaaguccuucuacaagaaccugaucuggcucgugaagaaggggaacagcuaccccaagcuguccaagucguacaucaacgacaagggcaaggaggugcugguccucugggggauccaccaccccagcacguccgcggaccagcagagccuguaccagaacgccgacgccuacguguucgugggcuccucgcgguacuccaagaaguucaagcccgagaucgccauccgcccgaagguccgggaccaggagggccgcaugaacuacuacuggacccugguggagcccggggacaagaucaccuucgaggccaccggcaaccucguggucccccgguacgcguucgccauggagcgcaacgccgggagcggcaucaucaucuccgacacgcccgugcacgacugcaacacgaccugccagaccccgaagggcgccaucaacaccucgcugcccuuccagaacauccaccccaucaccaucgggaagugccccaaguacgugaaguccaccaagcugcggcucgccaccggccugcgcaacgucccgagcauccagucccgggggcuguucggcgcgaucgccggguucaucgagggcggcuggacggggaugguggacggcugguacggguaccaccaccagaacgagcagggcucgggguacgccgccgaccucaaguccacccagaacgccaucgacgagaucaccaacaaggugaacagcgucaucgagaagaugaacacccaguucacggcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaaguccaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcaucaagcucgagucgacccgcaucuaccagauccuggccaucuacagcaccguggcguccucgcugguccucguggugucccugggggccaucagcuucuggaugugcuccaacggcagccugcagugccggaucugcaucuga

SEQ ID NO: 3196 - RNA, 1701 nt, Artificial Sequence; identical to SEQ ID NO: 91
  derived and/or modified CDS sequence (AUadapt) from InfluenzaA__ACS45035__HA

SEQ ID NO: 3197 - RNA, 1701 nt, Artificial Sequence; identical to SEQ ID NO: 116
  derived and/or modified CDS sequence (AUadapt) from InfluenzaA__ACS50084__HA

SEQ ID NO: 3198 - RNA, 1701 nt, Artificial Sequence; identical to SEQ ID NO: 3156
  derived and/or modified CDS sequence (AUadapt) from InfluenzaA__ACS50095__HA

SEQ ID NO: 3199 - RNA, 1701 nt, Artificial Sequence
  derived and/or modified CDS sequence (AUadapt) from InfluenzaA__ACS54258__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacacgugcauggagagcgugaagaacgggaccuacuacuaccccaaguacuccgaggaggccaagcugaaccgggaggagaucgacggcgugaagcucgagucgacccgcaucuaccagauccuggcgaucuacuccaccgucgccagcucgcuggugcucguggucucccugggggccaucagcuucuggaugugcuccaacggcagccugcagugccggaucugcaucuga

SEQ ID NO: 3200 - RNA, 1701 nt, Artificial Sequence; identical to SEQ ID NO: 92
  derived and/or modified CDS sequence (AUadapt) from InfluenzaA__ACS54259__HA

SEQ ID NO: 3201 - RNA, 1701 nt, Artificial Sequence; identical to SEQ ID NO: 62
  derived and/or modified CDS sequence (AUadapt) from InfluenzaA__ACS54260__HA

SEQ ID NO: 3202 - RNA, 1701 nt, Artificial Sequence; identical to SEQ ID NO: 116
  derived and/or modified CDS sequence (AUadapt) from InfluenzaA__ACS54261__HA

SEQ ID NO: 3203 - RNA, 1701 nt, Artificial Sequence; identical to SEQ ID NO: 116
  derived and/or modified CDS sequence (AUadapt) from InfluenzaA__ACS54263__HA

SEQ ID NO: 3204 - RNA, 1701 nt, Artificial Sequence; identical to SEQ ID NO: 116
  derived and/or modified CDS sequence (AUadapt) from InfluenzaA__ACS54301__HA

SEQ ID NO: 3205 - RNA, 1701 nt, Artificial Sequence; identical to SEQ ID NO: 62
  derived and/or modified CDS sequence (AUadapt) from InfluenzaA__ACS66821__HA

SEQ ID NO: 3206 - RNA, 1701 nt, Artificial Sequence
  derived and/or modified CDS sequence (AUadapt) from InfluenzaA__ACS68822__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggggcuccgggagcagcugucguccgugagcuccuucgagcgcuucgagaucuuccccaagaccucguccuggcccaaccacgacagcaacaagggcgucaccgccgccugcccgcacgccggggcgaaguccuucuacaagaaccugaucuggcucgugaagaagggcaacucguaccccaagcuguccaagagcuacaucaacgacaaggggaaggaggugcugguccucuggggcauccaccaccccucgaccuccgccgaccagcagagccuguaccagaacgccgacgccuacguguucgugggcacgucccgguacucgaagaaguucaagcccgagaucgccauccgcccgaagguccgggaccaggaggggcgcaugaacuacuacuggacccugguggagcccggcgacaagaucaccuucgaggcgaccgggaaccucguggucccccgguacgccuucgccauggagcgcaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagucgaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaagaucgacgacggguuccucgacaucuggaccuacaacgccgagcugcugguccuccuggagaacgagcggacccuggacuaccacgacagcaacgugaagaaccucuacgagaaggugcgcucccagcugaagaacaacgccaaggagaucggcaacgggugcuucgaguucuaccacaagugcgacaacacgugcauggagucggucaagaacggcaccuacgacuaccccaaguacuccgaggaggccaagcugaaccgggaggagaucgacggggugaagcucgagagcacccgcaucuaccagauccuggcgaucuacuccaccguggccucgagccugguccucguggugucccugggcgccaucucguucuggaugugcuccaacggcagccugcagugccggaucugcaucuga

SEQ ID NO: 3207 - RNA, 1701 nt, Artificial Sequence; identical to SEQ ID NO: 116
  derived and/or modified CDS sequence (AUadapt) from InfluenzaA__ACS75821__HA

SEQ ID NO: 3208 - RNA, 1701 nt, Artificial Sequence; identical to SEQ ID NO: 116
  derived and/or modified CDS sequence (AUadapt) from InfluenzaA__ACS77926__HA

SEQ ID NO: 3209 - RNA, 1701 nt, Artificial Sequence; identical to SEQ ID NO: 116
  derived and/or modified CDS sequence (AUadapt) from InfluenzaA__ACS77936__HA

SEQ ID NO: 3210 - RNA, 1701 nt, Artificial Sequence; identical to SEQ ID NO: 3007
  derived and/or modified CDS sequence (AUadapt) from InfluenzaA__ACS77946__HA

SEQ ID NO: 3211 - RNA, 1701 nt, Artificial Sequence; identical to SEQ ID NO: 116
  derived and/or modified CDS sequence (AUadapt) from InfluenzaA__ACS77956__HA

SEQ ID NO: 3212 - RNA, 1701 nt, Artificial Sequence; identical to SEQ ID NO: 116
  derived and/or modified CDS sequence (AUadapt) from InfluenzaA__ACS77966__HA

SEQ ID NO: 3213 - RNA, 1701 nt, Artificial Sequence; identical to SEQ ID NO: 116
  derived and/or modified CDS sequence (AUadapt) from InfluenzaA__ACS77976__HA

SEQ ID NO: 3214 - RNA, 1701 nt, Artificial Sequence; identical to SEQ ID NO: 3156
  derived and/or modified CDS sequence (AUadapt) from InfluenzaA__ACS77986__HA

SEQ ID NO: 3215 - RNA, 1701 nt, Artificial Sequence
  derived and/or modified CDS sequence (AUadapt) from InfluenzaA__ACS77996__HA
augaaggccacccuggugguccuccuguacaccuucgccacggcgaacgccgacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagacguccagcuccgacaacgggaccugcuaccccggcgacuucaucgacuacgaggagcuccgggagcagcugucguccgugagcuccuucgagcgcuucgagaucuuccccaagaccucguccuggcccaaccacgacucgaacaagggcgucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcacguccgccgaccagcagucgcuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccggguccggcaucaucaucucggacacccccgugcacgacugcaacacgaccugccagaccccgaagggcgccaucaacaccucccugcccuuccagaacauccaccccaucaccaucgggaagugccccaaguacgucaagagcaccaagcugcggcucgcgacgggccugcgcaacgugccguccauccagucgcgggggcuguucggcgccaucgccggguucaucgagggcggcuggaccgggaugguggacggcugguacggguaccaccaccagaacgagcagggcuccggguacgccgccgaccucaagucgacccagaacgcgaucgacgagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 3216 - RNA, 1701 nt, Artificial Sequence; identical to SEQ ID NO: 116
  derived and/or modified CDS sequence (AUadapt) from InfluenzaA__ACS78006__HA

SEQ ID NO: 3217 - RNA, 1701 nt, Artificial Sequence; identical to SEQ ID NO: 116
  derived and/or modified CDS sequence (AUadapt) from InfluenzaA__ACS78016__HA

SEQ ID NO: 3218 - RNA, 1701 nt, Artificial Sequence
  derived and/or modified CDS sequence (AUadapt) from InfluenzaA__ACS78026__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaucagcuccuggcccaaccacgacagcaaccgcggggucaccgccgccugcccgcacgccggcgcgaaguccuucuacaagaaccugaucuggcucgugaagaaggggaacucguaccccaagcugaucaaguccuacaucaacgacaagggcaaggaggugcugguccucugggggauccaccaccccagcaccucggccgaccagcagucccuguaccagaacgccgacgccuacguguucgugggcagcucccgguacucgaagaaguucaagcccgagaucgccauccggccgaagguccgcgaccaggagggccggaugaacuacuacuggacccugguggagcccggggacaagaucacguucgaggcgaccggcaaccucguggucccccgcuacgccuucgccauggagcggaacgccggguccggcaucaucaucagcgacacccccgugcacgacugcaacaccacgugccagaccccgaagggcgccaucaacaccucccugcccuuccagaacauccaccccaucaccaucgggaagugccccaaguacgucaagucgacgaagcugcgccucgcgaccggccugcggaacgugccguccauccagagccgcgggcuguucggcgccaucgccggguucaucgagggcggcuggaccgggaugguggacggcugguacggguaccaccaccagaacgagcagggcuccggguacgccgccgaccucaagagcacccagaacgcgaucgacgagaucacgaacaaggugaacuccgucaucgagaagaugaacacccaguucaccgccgugggcaaggaguucaaccaccuggagaagcggaucgagaaccugaacaagaaggucgacgacggcuuccucgacaucuggaccuacaacgccgagcugcuggugcuccuggagaacgagcgcacgcuggacuaccacgacucgaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagucgacccggaucuaccagauccuggcgaucuacuccaccgucgccagcucgcuggugcucguggucucccugggggccaucagcuucuggaugugcuccaacggcagccugcagugccgcaucugcaucuga

SEQ ID NO: 3219 - RNA, 1701 nt, Artificial Sequence; identical to SEQ ID NO: 3156
  derived and/or modified CDS sequence (AUadapt) from InfluenzaA__ACS78036__HA

SEQ ID NO: 3220 - RNA, 1701 nt, Artificial Sequence; identical to SEQ ID NO: 3156
  derived and/or modified CDS sequence (AUadapt) from InfluenzaA__ACS78046__HA

SEQ ID NO: 3221 - RNA, 1701 nt, Artificial Sequence; identical to SEQ ID NO: 92
  derived and/or modified CDS sequence (AUadapt) from InfluenzaA__ACS92569__HA

SEQ ID NO: 3222 - RNA, 1701 nt, Artificial Sequence; identical to SEQ ID NO: 92
  derived and/or modified CDS sequence (AUadapt) from InfluenzaA__ACS92579__HA

SEQ ID NO: 3223 - RNA, 1701 nt, Artificial Sequence; identical to SEQ ID NO: 116
  derived and/or modified CDS sequence (AUadapt) from InfluenzaA__ACS92589__HA

SEQ ID NO: 3224 - RNA, 1701 nt, Artificial Sequence
  derived and/or modified CDS sequence (AUadapt) from InfluenzaA__ACS92612__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccauccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcuccucgcgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcgacacgaccugccagaccccgaagggcgccaucaacaccucgcugcccuuccagaacauccaccccaucacgaucgggaagugccccaaguacgugaaguccaccaagcugcggcucgcgaccggccugcgcaacaucccgagcauccagucccgggggcuguucggcgccaucgccggguucaucgagggcggcuggaccgggauggucgacggcugguacggguaccaccaccagaacgagcagggcagcggguacgccgccgaccucaaguccacgcagaacgcgaucgacgagaucaccaacaaggugaacucggugaucgagaagaugaacacccaguucaccgccgucggcaaggaguucaaccaccuggagaagcgcaucgagaaccugaacaagaagguggacgacggcuuccucgacaucuggacguacaacgccgagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuaccccaaguacucggaggaggccaagcugaaccgggaggagaucgacggcgugaagcucgaguccacccgcaucuaccagauccuggcgaucuacagcaccguggccucgucccugguccucguggugagccugggggccaucuccuucuggaugugcagcaacggcucccugcagugccggaucugcaucuga

SEQ ID NO: 3225 - RNA, 1701 nt, Artificial Sequence; identical to SEQ ID NO: 116
  derived and/or modified CDS sequence (AUadapt) from InfluenzaA__ACT10307__HA

SEQ ID NO: 3226 - RNA, 1701 nt, Artificial Sequence; identical to SEQ ID NO: 116
  derived and/or modified CDS sequence (AUadapt) from InfluenzaA__ACT10314__HA

SEQ ID NO: 3227 - RNA, 1701 nt, Artificial Sequence
  derived and/or modified CDS sequence (AUadapt) from InfluenzaA__ACT11057__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccucguccuggagcuacaucguggagaccuccucguccgacaacggcacgugcuaccccggcgacuucaucgacuacgaggagcugcgggagcagcucagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcuggugaagaaggggaacagcuaccccaagcucuccaagucguacaucaacgacaagggcaaggaggugcugguccugugggggauccaccaccccagcaccuccgccgaccagcagucgcucuaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggucgggcaucaucaucuccgacacccccgugcacgacugcaacacgaccugccagaccccgaagggcgccaucaacaccagccuccccuuccagaacauccaccccaucacgaucgggaagugccccaaguacgugaaguccaccaagcugcggcuggcgaccggccuccgcaacgucccgucgauccagucccgggggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacucggucaucgagaagaugaacacccaguucaccgccgugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcagccagcucaagaacaacgccaaggagguggggaacggcugcuucgaguucuaccacaagugcgacaacacgugcauggaguccgugaagaacgggaccuacgacuaccccaaguacucggaggaggccaagcugaaccgggaggagaucgacggcgucaagcuggaguccacccgcaucuaccagauccucgcgaucuacagcaccguggccucgucccuggugcuggucgugagccucggggccaucuccuucuggaugugcagcaacggcucccugcagugccggaucugcaucuga

SEQ ID NO: 3228 - RNA, 1704 nt, Artificial Sequence
  derived and/or modified CDS sequence (AUadapt) from InfluenzaA__ACT15312__HA
auggagaagaucgugcugcuccuggccaucgucucgaucgugaaguccgaccagaucugcaucggcuaccacgccaacaacucgaccgagcaggucgacaccaucauggagaagaacgugacggugacccacgcgcaggacauccuggagaagacccacaacgggaagcucugcaaccuggacggcgugaagccccugauccuccgcgacugcuccgucgccggguggcugcugggcaacccgaugugcgacgaguuccucaacgugcccgaguggagcuacaucguggagaagaucaaccccgccaacgaccugugcuaccccgggaacuucaacgacuacgaggagcugaagcaccuccugucccggaucaaccacuucgagaagauccagaucaucccgaagaacucgugguccgaccacgaggccagcggcgucuccucggccugccccuaccagggccgcuccagcuucuuccggaacgugguguggcugaccaagaagaacaacgcguaccccacgaucaagcgcuccuacaacaacaccaaccaggaggaccuccugguccugugggggauccaccaccccaacgacgccgccgagcagacccggcucuaccagaacccgaccacguacaucucggugggcaccuccacccugaaccagcgccuggugcccaagaucgccacccggucgaaggucaacgggcaguccggccgcauggaguucuucuggacgauccucaagagcaacgacgcgaucaacuucgaguccaacgggaacuucaucgcccccgagaacgccuacaagaucgugaagaagggcgacucgaccaucaugaaguccgagcuggaguacggcaacugcaacaccaagugccagacccccaucggggccaucaacagcucgaugccguuccacaacauccacccccugacgaucggcgagugccccaaguacgugaaguccaaccggcucguccuggccaccgggcugcgcaacagcccccagggcgagcggcgccggaagaagcgcggccucuucggggcgaucgccggcuucaucgagggcggguggcaggggaugguggacggcugguacggcuaccaccacuccaacgagcaggggucgggcuacgccgccgacaaggaguccacccagaaggccaucgacggggugaccaacaaggucaacucgaucaucgacaagaugaacacgcaguucgaggcggugggccgggaguucaacaaccuggagcgccggaucgagaaccugaacaagaagauggaggacggguuccucgacguguggaccuacaacgccgagcugcugguccucauggagaacgagcgcacccuggacuuccacgacuccaacgugaagaaccuguacgacaagguccggcuccagcugcgcgacaacgccaaggagcugggcaacggcugcuucgaguucuaccaccggugcgacaacgagugcauggagagcgugcgcaacgggaccuacgacuacccgcaguacuccgaggaggcccgccucaagcgggaggagaucucgggcgugaagcuggaguccaucgggacguaccagauccugagcaucuacuccaccgucgccucgucccucgcgcuggccaucaugguggccggccuguuccucuggaugugcagcaacgggucccugcagugccgcaucugcaucuga

SEQ ID NO: 3229 - RNA, 1704 nt, Artificial Sequence
  derived and/or modified CDS sequence (AUadapt) from InfluenzaA__ACT15314__HA
auggagaagaucgugcugcuccuggccaucgucucgcuggugaaguccgaccagaucugcaucggcuaccacgccaacaacucgaccgagcaggucgacaccaucauggagaagaacgugacggugacccacgcgcaggacauccucgagaagacccacaacgggaagcugugcaaccuggacggcgugaagccccucauccugcgcgacugcuccgucgccggguggcugcucggcaacccgaugugcgacgaguuccugaacgugcccgaguggagcuacaucguggagaagaucaaccccgccaacgaccugugcuaccccgggaacuucaacgacuacgaggagcucaagcaccuccugucccggaucaaccacuucgagaagauccagaucaucccgaagaacucgugguccgaccacgaggccagcggcgucuccucggccugccccuaccagggccgcuccagcuucuuccggaacgugguguggcugaccaagaagaacaacgcguaccccacgaucaagcgcuccuacaacaacaccaaccaggaggaccugcugguccucugggggauccaccaccccaacgacgccgccgagcagacccggcuguaccagaacccgaccacguacaucucggugggcaccuccacccugaaccagcgccucgugcccaagaucaccacgcggucgaaggucaacgggcaguccggccgcauggaguucuucuggaccauccucaagagcaacgacgccaucaacuucgaguccaacgggaacuucaucgcgcccgagaacgccuacaagaucgugaagaagggcgacucgaccaucaugaaguccgagcuggaguacggcaacugcaacaccaagugccagacgcccaucggggccaucaacagcucgaugccguuccacaacauccacccccugaccaucggcgagugccccaaguacgugaaguccaaccggcugguccuggccaccgggcuccgcaacagcccccagggcgagcggcgccggaagaagcgcggccuguucggggccaucgcgggcuucaucgagggcggguggcaggggaugguggacggcugguacggcuaccaccacuccaacgagcaggggucgggcuacgccgccgacaaggaguccacccagaaggccaucgacggggugacgaacaaggucaacucgaucaucgacaagaugaacacccaguucgaggccgugggccgggaguucaacaaccuggagcgccggaucgagaaccucaacaagaagauggaggacggguuccuggacguguggaccuacaacgcggagcugcucguccugauggagaacgagcgcacccuggacuuccacgacuccaacgugaagaaccucuacgacaagguccggcugcagcugcgcgacaacgccaaggagcucggcaacggcugcuucgaguucuaccaccggugcgacaacgagugcauggagagcgugcgcaacgggacguacgacuacccgcaguacuccgaggaggcccgccugaagcgggaggagaucucgggcgugaagcuggaguccaucgggaccuaccagauccucagcaucuacuccaccgucgccucgucccuggcccuggcgaucaugguggccggccucuuccuguggaugugcagcaacgggucccugcagugccgcaucugcaucuga

SEQ ID NO: 3230 - RNA, 1704 nt, Artificial Sequence
  derived and/or modified CDS sequence (AUadapt) from InfluenzaA__ACT15316__HA
auggagaagaucgugcugcuccuggccaucgucucgcuggugaaguccgaccagaucugcaucggcuaccacgccaacaacucgaccgagcaggucgacaccaucauggagaagaacgugacggugacccacgcgcaggacauccucgagaagacccacaacgggaagcugugcaaccuggacggcgugaagccccucauccugcgcgacugcuccgucgccggguggcugcucggcaacccgaugugcgacgaguuccugaacgugcccgaguggagcuacaucguggagaagaucaaccccgccaacgaccugugcuaccccgggaacuucaacgacuacgaggagcucaagcaccuccugucccggaucaaccacuucgagaagauccagaucaucccgaagaacucgugguccgaccacgaggccagcggcgucuccucggccugccccuaccagggccgcuccagcuucuuccggaacgugguguggcugaccaagaaggacaacgcguaccccacgaucaagcgcuccuacaacaacaccaaccaggaggaccugcugguccucugggggauccaccaccccaacgacgccgccgagcagacccggcuguaccagaacccgaccacguacaucucggugggcaccuccacccugaaccagcgccucauccccaagaucgccacccggucgaaggugaacgggcaguccggccgcauggaguucuucuggacgauccucaagagcaacgacgcgaucaacuucgaguccaacgggaacuucaucgcccccgagaacgccuacaagaucgucaagaagggcgacucgaccaucaugaaguccgagcuggaguacggcaacugcaacaccaagugccagacccccaucggggccaucaacagcucgaugccguuccacaacauccacccccugacgaucggcgagugccccaaguacgugaaguccaaccggcuggugcuggccaccgggcuccgcaacagcccccagggcgagcggcgccggaagaagcgcggccuguucggggcgaucgccggcuucaucgagggcggguggcaggggauggucgacggcugguacggcuaccaccacuccaacgagcaggggucgggcuacgccgccgacaaggaguccacccagaaggccaucgacggggugaccaacaaggugaacucgaucaucgacaagaugaacacgcaguucgaggcggucggccgggaguucaacaaccuggagcgccggaucgagaaccucaacaagaagauggaggacggguuccuggacguguggaccuacaacgccgagcugcucgugcugauggagaacgagcgcacccuggacuuccacgacuccaacgucaagaaccucuacgacaaggugcggcugcagcugcgcgacaacgccaaggagcucggcaacggcugcuucgaguucuaccaccggugcgacaacgagugcauggagagcguccgcaacgggaccuacgacuacccgcaguacuccgaggaggcccgccugaagcgggaggagaucucgggcgugaagcuggaguccaucgggacguaccagauccucagcaucuacuccaccguggccucgucccuggcgcuggccaucauggucgccggccucuuccuguggaugugcagcaacgggucccugcagugccgcaucugcaucuga

SEQ ID NO: 3231 - RNA, 1704 nt, Artificial Sequence
  derived and/or modified CDS sequence (AUadapt) from InfluenzaA__ACT15320__HA
auggagaagaucgugcugcuccuggccaucgucucgcuggugaaguccgaccagaucugcaucggcuaccacgccaacaacucgaccgagcaggucgacaccaucauggagaagaacgugacggugacccacgcgcaggacauccucgagaagacccacaacgggaagcugugcaaccuggacggcgugaagccccucauccugcgcgacugcuccgucgccggguggcugcucggcaacccgaugugcgacgaguuccugaacgugcccgaguggagcuacaucguggagaagaucaaccccgccaacgaccugugcuaccccgggaacuucaacgacuacgaggagcucaagcaccuccugucccggaucaaccacuucgagaagauccagaucaucccgaagaacucgugguccgaccacgaggccagcggcauguccucggccugccccuaccagggccgcuccagcuucuuccggaacgucguguggcugaccaagaaggacaacgcguaccccacgaucaagcgcuccuacaacaacaccaaccaggaggaccugcuggugcucugggggauccaccaccccaacgacgccgccgagcagacccggcuguaccagaacccgaccacguacaucucggucggcaccuccacccugaaccagcgccucgugcccaagaucgccacccggucgaaggugaacgggcaguccggccgcauggaguucuucuggacgauccucaagagcaacgacgcgaucaacuucgaguccaacgggaacuucaucgcccccgagaacgccuacaagaucgucaagaagggcgacucgaccaucaugaaguccgagcuggaguacggcaacugcaacaccaagugccagacccccaucggggccaucaacagcucgaugccguuccacaacauccacccccugacgaucggcgagugccccaaguacgugaaguccaaccggcuggugcuggccaccgggcuccgcaacagcccccagggcgagcggcgccggaagaagcgcggccuguucggggcgaucgccggcuucaucgagggcggguggcaggggauggucgacggcugguacggcuaccaccacuccaacgagcaggggucgggcuacgccgccgacaaggaguccacccagaaggccaucgacggggugaccaacaaggugaacucgaucaucgacaagaugaacacgcaguucgaggcggucggccgggaguucaacaaccuggagcgccggaucgagaaccucaacaagaagauggaggacggguuccuggacguguggaccuacaacgccgagcugcucgugcugauggagaacgagcgcacccuggacuuccacgacuccaacgucaagaaccucuacgacaaggugcggcugcagcugcgcgacaacgccaaggagcucggcaacggcugcuucgaguucuaccaccggugcgacaacgagugcauggagagcguccgcaacgggaccuacgacuacccgcaguacuccgaggaggcccgccugaagcgggaggagaucucgggcgugaagcuggaguccaucgggacguaccagauccucagcaucuacuccaccguggccucgucccuggcgcuggccaucauggucgccggccucuuccuguggaugugcagcaacgggucccugcagugccgcaucugcaucuga

SEQ ID NO: 3232 - RNA, 1704 nt, Artificial Sequence
  derived and/or modified CDS sequence (AUadapt) from InfluenzaA__ACT15322__HA
auggagaagaucgugcugcuccuggccaucgucucgcuggugaaguccgaccagaucugcaucggcuaccacgccaacaacucgaccgagcaggucgacaccaucauggagaagaacgugacggugacccacgcgcaggacauccucgagaagacccacaacgggaagcugugcaaccuggacggcgugaagccccucauccugcgcgacugcuccgucgccggguggcugcucggcaacccgaugugcgacgaguuccugaacgugcccgaguggagcuacaucguggagaagaucaaccccgccaacgaccugugcuaccccgggaacuucaacgacuacgaggagcucaagcaccuccugucccggaucaaccacuucgagaagauccagaucaucccgaagaacucgugguccgaccacgaggccagcggcgucuccucggccugccccuaccagggccgcuccagcuucuuccggaacgugguguggcugaccaagaaggacaacgcguaccccacgaucaagcgcuccuacaacaacaccaaccaggaggaccugcugguccucugggggauccaccaccccaacgacgccgccgagcagacccggcuguaccagaacccgaccacguacaucucggugggcaccuccacccugaaccagcgccucgugcccaagaucgccacccggagcaaggucaacgggcaguccggccgcauggaguucuucuggacgauccucaagucgaacgacgcgaucaacuucgaguccaacgggaacuucaucgcccccgagaacgccuacaagaucgugaagaagggcgacagcaccaucaugaaguccgagcuggaguacggcaacugcaacaccaagugccagacccccaucggggccaucaacucgucgaugccguuccacaacauccacccccugacgaucggcgagugccccaaguacgugaaguccaaccggcugguccuggccaccgggcuccgcaacagcccccagggcgagcggcgccggaagaagcgcggccuguucggggcgaucgccggcuucaucgagggcggguggcaggggaugguggacggcugguacggcuaccaccacuccaacgagcaggggucgggcuacgccgccgacaaggaguccacccagaaggccaucgacggggugaccaacaaggucaacagcaucaucgacaagaugaacacgcaguucgaggcggugggccgggaguucaacaaccuggagucccgcaucgagaaccucaacaagaagauggaggacggguuccuggacguguggaccuacaacgccgagcugcucguccugauggagaacgagcggacccuggacuuccacgacucgaacgugaagaaccucuacgacaagguccgccugcagcugcgggacaacgccaaggagcucggcaacggcugcuucgaguucuaccaccgcugcgacaacgagugcauggaguccgugcggaacgggaccuacgacuacccgcaguacagcgaggaggcccgccugaagcgcgaggagaucuccggcgugaagcuggagucgaucgggacguaccagauccucuccaucuacagcaccgucgccuccucgcuggcgcuggccaucaugguggccggccucuuccuguggaugugcuccaacgggagccugcagugccggaucugcaucuga

SEQ ID NO: 3233 - RNA, 1704 nt, Artificial Sequence
  derived and/or modified CDS sequence (AUadapt) from InfluenzaA__ACT15326__HA
auggagaagaucgugcugcuccuggccaucgucucgcuggugaaguccgaccagaucugcaucggcuaccacgccaacaacucgaccgagcaggucgacaccaucauggagaagaacgugacggugacccacgcgcaggacauccucgagaagacccacaacgggaagcugugcaaccuggacggcgugaagccccucauccugcgcgacugcuccgucgccggguggcugcucggcaacccgaugugcgacgaguuccugaacgugcccgaguggagcuacaucguggagaagaucaaccccgccaacgaccugugcuaccccgggaacuucaacgacuacgaggagcucaagcaccuccugucccggaucaaccacuucgagaagauccagaucaucccgaagaacucgugguccgaccacgaggccucgggcgucuccagcgccugccccuaccagggccgcuccucguucuuccggaacgugguguggcugaccaagaaggacaacgcguaccccacgaucaagcgcuccuacaacaacaccaaccaggaggaccugcugguccucugggggauccaccaccccaacgacgccgccgagcagacccggcuguaccagaacccgaccacguacaucagcgugggcaccuccacccugaaccagcgccucauccccaagaucgccacccggucgaaggugaacgggcaguccggccgcauggaguucuucuggacgauccugaagcccaacgacgcgaucaacuucgagucgaacgggaacuucaucgcccccgagaacgccuacaagaucgucaagaagggcgacuccaccaucaugaaguccgagcuggaguacggcaacugcaacaccaagugccagaccccgaucggggccaucaacagcucgaugcccuuccacaacauccacccccucacgaucggcgagugccccaaguacgucaagucgaaccggcuggugcuggccaccgggcuccgcaacuccccgcagggcgagcggcgccggaagaagcgcggccuguucggggcgaucgccggcuucaucgagggcggguggcaggggaugguggacggcugguacggcuaccaccacagcaacgagcagggguccggcuacgccgccgacaaggagucgacccagaaggccaucgacggggugaccaacaaggugaacuccaucaucgacaagaugaacacgcaguucgaggcggucggccgggaguucaacaaccuggagcgccggaucgagaaccucaacaagaagauggaggacggguuccuggacguguggaccuacaacgccgagcugcucgugcugauggagaacgagcgcacccuggacuuccacgacagcaacgucaagaaccucuacgacaaggugcggcugcagcugcgcgacaacgccaaggagcucggcaacggcugcuucgaguucuaccaccggugcgacaacgagugcauggaguccguccgcaacgggaccuacgacuacccccaguacucggaggaggcccgccugaagcgggaggagaucuccggcgugaagcuggagucgaucgggacguaccagauccucuccaucuacagcaccguggccuccucgcuggcgcuggccaucauggucgccggccucuuccuguggaugugcuccaacgggagccugcagugccgcaucugcaucuga

SEQ ID NO: 3234 - RNA, 1704 nt, Artificial Sequence
  derived and/or modified CDS sequence (AUadapt) from InfluenzaA__ACT15328__HA
auggagaagaucgugcugcuccuggccaucgucucgcuggugaaguccgaccagaucugcaucggcuaccacgccaacaacucgaccgagcaggucgacaccaucauggagaagaacgugacggugacccacgcgcaggacauccucgagaagacccacaacgggaagcugugcaaccuggacggcgugaagccccucauccugcgcgacugcuccgucgccggguggcugcucggcaacccgaugugcgacgaguuccugaacgugcccgaguggagcuacaucguggagaagaucaaccccgccaacgaccugugcuaccccgggaacuucaacgacuacgaggagcucaagcaccuccugucccggaucaaccacuucgagaagauccagaucaucccgaagaacucgugguccgaccacgaggccucgggcgucuccagcgccugccccuaccagggccgcuccucguucuuccggaacgugguguggcugaccaagaaggacaacgcguaccccacgaucaagcgcuccuacaacaacaccaaccaggaggaccugcugguccucugggggauccaccaccccaacgacgccgccgagcagacccggcuguaccagaacccgaccacguacaucagcgugggcaccuccacccugaaccagcgccucgugcccaagaucgccacccggucgaaggucaacgggcagaacggccgcauggaguucuucuggacgauccugaaguccaacgacgcgaucaacuucgagucgaacgggaacuucaucgcccccgagaacgccuacaagaucgugaagaagggcgacuccaccaucaugaaguccgagcuggaguacggcaacugcaacaccaagugccagacccccaucggggccaucaacagcuccaugccguuccacaacauccacccccucacgaucggcgagugccccaaguacgucaagucgaaccggcuggugcuggccaccgggcuccgcaacucgccccagggcgagcggcgccggaagaagcgcggccuguucggggcgaucgccggcuucaucgagggcggguggcaggggaugguggacggcugguacggcuaccaccacagcaacgagcagggguccggcuacgccgccgacaaggagucgacccagaaggccaucgacggggugaccaacaaggucaacuccaucaucgacaagaugaacacgcaguucgaggcggugggccgggaguucaacaaccuggagcgccggaucgagaaccucaacaagaagauggaggacggguuccuggacguguggaccuacaacgccgagcugcucguccugauggagaacgagcgcacccuggacuuccacgacagcaacgugaagaaccucuacgacaagguccggcugcagcugcgcgacaacgccaaggagcucggcaacggcugcuucgaguucuaccaccggugcgacaacgagugcauggaguccgugcgcaacgggaccuacgacuacccgcacuacucggaggaggcccgccugaagcgggaggagaucuccggcgugaagcuggagucgaucgggacguaccagauccucuccaucuacagcaccgucgccuccucgcuggcgcuggccaucaugguggccggccucuuccuguggaugugcuccaacgggagccugcagugccgcaucugcaucuga

SEQ ID NO: 3235 - RNA, 1704 nt, Artificial Sequence
  derived and/or modified CDS sequence (AUadapt) from InfluenzaA__ACT15330__HA
auggagaagaucgugcugcuccuggccaucgucucgcuggugaaguccgaccagaucugcaucggcuaccacgccaacaacucgaccgagcaggucgacaccaucauggagaagaacgugacggugacccacgcgcaggacauccucgagaagacccacaacgggaagcugugcaaccuggacggcgugaagccccucauccugcgcgacugcuccgucgccggguggcugcucggcaacccgaugugcgacgaguuccugaacgugcccgaguggagcuacaucguggagaagaucaaccccgccaacgaccugugcuaccccgggaacuucaacgacuacgaggagcucaagcaccuccugucccggaucaaccacuucgagaagauccagaucaucccgaagaacucgugguccgaccacgaggccagcggcgucuccucggccugccccuaccagggccgcuccagcuucuuccggaacgugguguggcugaccaagaaggacaacgcguaccccacgaucaagcgcuccuacaacaacaccaaccaggaggaccugcugguccucugggggauccaccaccccaacgacgccgccgagcagacccggcuguaccagaacccgaccacguacaucucggugggcaccuccacccugaaccagcgccucgugcccaagaucgccacccggucgaaggucaacgggcaguccggccgcauggaguucuucuggacgauccucaagagcaacgacgcgaucaacuucgaguccaacgggaacuucaucgcccccgagaacgccuacaagaucgugaagaagggcgacucgaccaucaugaaguccgagcuggaguacggcaacugcaacaccaagugccagacccccaucggggccaucaacagcucgaugccguuccacaacauccacccccugacgaucggcgagugccccaaguacgugaaguccaaccggcugguccuggccaccgggcuccgcaacagcccccagggcgagcggcgccggaagaagcgcggccuguucggggcgaucgccggcuucaucgagggcggguggcaggggaugguggacggcugguacggcuaccaccacuccaacgagcaggggucgggcuacgccgccgacaaggaguccacccagaaggccaucgacggggugaccaacaaggucaacucgaucaucgacaagaugaacacgcaguucgaggcggugggccgggaguucaacaaccuggagcgccggaucgagaaccucaacaagaagauggaggacggguuccuggacguguggaccuacaacgccgagcugcucguccugauggagaacgagcgcacccuggacuuccacgacuccaacgugaagaaccucuacgacaagguccggcugcagcugcgcgacaacgccaaggagcucggcaacggcugcuucgaguucuaccaccggugcgacaacgagugcauggagagcgugcgcaacgggaccuacgacuacccgcacuacuccgaggaggcccgccugaagcgggaggagaucucgggcgugaagcuggaguccaucgggacguaccagauccucagcaucuacuccaccgucgccucgucccuggcgcuggccaucaugguggccggccucuuccuguggaugugcagcaacgggucccugcagugccgcaucugcaucuga

SEQ ID NO: 3236 - RNA, 1707 nt, Artificial Sequence
  derived and/or modified CDS sequence (AUadapt) from InfluenzaA__ACT15332__HA
auggagaagaucgugcugcuccuggccaucgucucgcuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguuccugaacgugcccgaguggucguacaucguggagaagaucaaccccgccaacgaccugugcuaccccggggacuucaacgacuacgaggagcucaagcaccuccugucccggaucaaccacuucgagaagauccagaucauccccaagagcuccuggagcgaccacgaggccuccucgggcgucuccagcgccugcccguaccagggccgcuccucguucuuccggaacgugguguggcugaucaagaaggacaacgcguaccccaccaucaagcgcuccuacaacaacacgaaccaggaggaccugcugguccucugggggauccaccaccccaacgacgccgccgagcagacccggcuguaccacaacccgaccaccuacaucagcgugggcacguccacccugaaccagcgccucgugcccaagaucgccacccggagcaagaucaacgggcaguccggccgcauggaguucuucuggaccauccugaagcccaacgacgcgaucaacuucgagucgaacgggaacuucaucgcccccgagaacgccuacaagaucgucaagaagggcgacagcacgaucaugaaguccgagcuggaguacggcaacugcaacaccaagugccagaccccgaucggggccaucaacucguccaugcccuuccacaacauccacccccucaccaucggcgagugccccaaguacgucaagagcucccggcuggugcuggccacggggcuccgcaacagcccgcagggcaagucccggcgcaagaagcggggccuguucggggcgaucgccggcuucaucgagggcggguggcaggggaugguggacggcugguacggcuaccaccacucgaacgagcagggguccggcuacgccgccgacaaggagagcacccagcgcgccaucgacggggugaccaacaaggugaacuccaucaucgacaagaugaacacccaguucgaggcggucggccgggaguucaacaaccuggagcgccggaucgagaaccucaacaagaagauggaggacggguuccuggacguguggacguacaacgccgagcugcucgugcugauggagaacgagcgcacccuggacuuccacgacucgaacgucaagaaccucuacgacaaggugcggcugcagcugcgcgacaacgccaaggagcucggcaacggcugcuucgaguucuaccaccggugcgacaacgagugcauggaguccguccgcaacgggaccuacgacuacccccaguacagcgaggaggcccgccugaagcgggaggagaucuccggcgugaagcuggagagcaucgggaucuaccagauccucuccaucuacucgaccguggccuccagccuggcgcuggccaucauggucgccggccucuuccuguggaugugcagcaacgggucccugcagugccgcaucugcaucuga

SEQ ID NO: 3237 - RNA, 1704 nt, Artificial Sequence
  derived and/or modified CDS sequence (AUadapt) from InfluenzaA__ACT15336__HA
auggagaagaucgugcugcuccuggccaucgucucgcuggugaaguccgaccagaucugcaucggcuaccacgccaacaacucgaccgagcaggucgacaccaucauggagaagaacgugacggugacccacgcgcaggacauccucgagaagacccacaacgggaagcugugcaaccuggacggcgugaagccccucauccugcgcgacugcuccgucgccggguggcugcucggcaacccgaugugcgacgaguuccugaacgugcccgaguggagcuacaucguggagaagaucaaccccgccaacgaccugugcuaccccgggaacuucaacgacuacgaggagcucaagcaccuccugucccggaucaaccacuucgagaagauccagaucaucccgaagaacucgugguccgaccacgaggccagcggcgucuccucggccugccccuaccagggccgcuccagcuucuuccggaacgugguguggcugaccaagaaggacaacgcguaccccacgaucaagcgcuccuacaacaacaccaaccaggaggaccugcugguccucugggggauccaccaccccaacgacgccgccgagcagacccggcuguaccagaacccgaccacguacaucucggugggcaccuccacccugaaccagcgccucgugcccaagaucgccacccggucgaaggucaacgggcaguccggccgcauggaguucuucuggacgauccucaagagcaacgacgcgaucaacuucgaguccaacgggaacuucaucgcccccgagaacgccuacaagaucgugaagaagggcgacucgaccaucaugaaguccgagcuggaguacggcaacugcaacaccaagugccagacccccaucggggccaucaacagcucgaugccguuccacaacauccacccccugacgaucggcgagugccccaaguacgugaaguccaaccggcugguccuggccaccgggcuccgcaacagcccccagggcgagcggcgccggaagaagcgcggccuguucggggcgaucgccggcuucaucgagggcggguggcaggggaugguggacggcugguacggcuaccaccacuccaacgagcaggggucgggcuacgccgccgacaaggaguccacccagaaggccaucgacggggugaccaacaaggucaacucgaucaucgacaagaugaacacgcaguucgaggcggugggccgggaguucaacaaccuggagcgccggaucgagaaccucaacaagaagauggaggacggguuccuggacguguggaccuacaacgccgagcugcucguccugauggagaacgagcgcacccuggacuuccacgacuccaacgugaagaaccucuacgacaagguccggcugcagcugcgcgacaacgccaaggagcucggcaacggcugcuucgaguucuaccaccggugcgacaacgagugcauggagagcgugcgcaacgggaccuacgacuacccgcaguacuccgaggaggcccgccugaagcgggaggagaucucgggcgugaagcuggaguccaucgggacguaccagauccucagcaucuacuccaccgucgccucgucccuggcgcuggccaucaugguggccggccucuuccuguggaugugcagcaacgggucccugcagugccgcaucugcaucuga

SEQ ID NO: 3238 - RNA, 1704 nt, Artificial Sequence
  derived and/or modified CDS sequence (AUadapt) from InfluenzaA__ACT15338__HA
auggagaagaucgugcugcuccuggccaucgucucgcuggugaaguccgaccagaucugcaucggcuaccacgccaacaacucgaccgagcaggucgacaccaucauggagaagaacgugacggugacccacgcgcaggacauccucgagaagacccacaacgggaagcugugcaaccuggacggcgugaagccccucauccugcgcgacugcuccgucgccggguggcugcucggcaacccgaugugcgacgaguuccugaacgugcccgaguggagcuacaucguggagaagaucaaccccgccaacgaccugugcuaccccgggaacuucaacgacuacgaggagcucaagcaccuccugucccggaucaaccacuucgagaagauccagaucaucccgaagaacucgugguccgaccacgaggccagcggcgucuccucggccugccccuaccagggccgcuccagcuucuuccggaacgugguguggcugaccaagaagaacaacgcguaccccacgaucaagcgcuccuacaacaacaccaaccaggaggaccugcugguccucugggggauccaccaccccaacgacgccaccgagcagacccggcuguaccagaacccgacgaccuacaucucggugggcaccuccacccugaaccagcgccucauccccaagaucgccacgcggucgaaggugaacgggcaguccggccgcauggaguucuucuggaccauccucaagagcaacgacgccaucaacuucgaguccaacgggaacuucaucgcgcccgagaacgccuacaagaucgucaagaagggcgacucgaccaucaugaaguccgagcuggaguacggcaacugcaacaccaagugccagacgcccaucggggccaucaacagcucgaugccguuccacaacauccacccccugaccaucggcgagugccccaaguacgugaaguccaaccggcuggugcuggccaccgggcuccgcaacagcccccaggagggccggcgccggaagaagcgcggccuguucggggccaucgcgggcuucaucgagggcggguggcaggggauggucgacggcugguacggcuaccaccacuccaacgagcaggggucgggcuacgccgccgacaaggaguccacccagaaggccaucgacggggugacgaacaaggugaacucgaucaucgacaagaugaacacccaguucgaggccgucggccgggaguucaacaaccuggagcgccggaucgagaaccucaacaagaagauggaggacggguuccuggacguguggaccuacaacgcggagcugcucgugcugauggagaacgagcgcacccuggacuuccacgacuccaacgucaagaaccucuacgacaaggugcggcugcagcugcgcgacaacgccaaggagcucggcaacggcugcuucgaguucuaccaccggugcgacaacgagugcauggagagcguccgcaacgggacguacgacuacccgcaguacuccgaggaggcccgccugaagcgggaggagaucucgggcgugaagcuggaguccaucgggaccuaccagauccucagcaucuacuccaccguggccucgucccuggcccuggcgaucauggucgccggccucuuccuguggaugugcagcaacgggucccugcagugccgcaucugcaucuga

SEQ ID NO: 3239 - RNA, 1704 nt, Artificial Sequence
  derived and/or modified CDS sequence (AUadapt) from InfluenzaA__ACT15340__HA
auggagaagaucgugcugcuccuggccaucgucucgcuggugaaguccgaccagaucugcaucggcuaccacgccaacaacucgaccgagcaggucgacaccaucauggagaagaacgugacggugacccacgcgcaggacauccucgagaagacccacaacgggaagcugugcaaccuggacggcgugaagccccucauccugcgcgacugcuccgucgccggguggcugcucggcaacccgaugugcgacgaguuccugaacgugcccgaguggagcuacaucguggagaagaucaaccccgccaacgaccugugcuaccccgggaacuucaacgacuacgaggagcucaagcaccuccugucccggaucaaccacuucgagaagauccagaucaucccgaagaacucgugguccgaccacgaggccagcggcgucuccucggccugccccuaccagggccgcuccagcuucuuccggaacgugguguggcugaccaagaagaacaacgcguaccccacgaucaagcgcuccuacaacaacaccaaccaggaggaccugcugguccucugggggauccaccaccccaacgacgccgaggagcagacccggcuguaccagaacccgaccacguacaucucggugggcaccuccacccugaaccagcgccucgugcccaagaucgccacccggucgaaggucaacgggcaguccggccgcauggaguucuucuggacgauccucaagagcaacgacgccaucaacuucgaguccaacgggaacuucaucgcgcccgagaacgccuacaagaucgugaagaagggcgacucgaccaucaugaaguccgagcuggaguacggcaacugcaacaccaagugccagacccccaucggggccaucaacagcucgaugccguuccacaacauccacccccugacgaucggcgagugccccaaguacgugaaguccaaccggcugguccuggccaccgggcuccgcaacagcccccagggcgagcggcgccggaagaagcgcggccuguucggggccaucgcgggcuucaucgagggcggguggcaggggaugguggacggcugguacggcuaccaccacuccaacgagcaggggucgggcuacgccgccgacaaggaguccacccagaaggccaucgacggggugaccaacaaggucaacucgaucaucgacaagaugaacacgcaguucgaggccgugggccgggaguucaacgcgcuggagcgccggaucgagaaccucaacaagaagauggaggacggguuccuggacguguggaccuacaacgccgagcugcucguccugauggagaacgagcgcacccuggacuuccacgacuccaacgugaagaaccucuacgacaagguccggcugcagcugcgcgacaacgccaaggagcucggcaacggcugcuucgaguucuaccaccggugcgacaacgagugcauggagagcgugcgcaacgggaccuacgacuacccgcaguacuccgaggaggcccgccugaagcgggaggagaucucgggcgugaagcuggaguccaucgggacguaccagauccucagcaucuacuccaccgucgccucgucccuggcgcuggccaucaugguggccggccucuuccuguggaugugcagcaacgggucccugcagugccgcaucugcaucuga

SEQ ID NO: 3240 - RNA, 1704 nt, Artificial Sequence
  derived and/or modified CDS sequence (AUadapt) from InfluenzaA__ACT15342__HA
auggagaagaucgugcugcuccuggccaucgucucgcuggugaaguccgaccagaucugcaucggcuaccacgccaacaacucgaccgagcaggucgacaccaucauggagaagaacgugacggugacccacgcgcaggacauccucgagaagacccacaacgggaagcugugcaaccuggacggcgugaagccccucauccugcgcgacugcuccgucgccggguggcugcucggcaacccgaugugcgacgaguuccugaacgugcccgaguggagcuacaucguggagaagaucaaccccgccaacgaccugugcuaccccggguccuucaacgacuacgaggagcucaagcaccuccugucgcggaucaaccacuucgagaagauccagaucaucccgaagaacuccuggagcgaccacgaggccuccggcgucucguccgccugccccuaccagggccgcagcuccuucuuccggaacgugguguggcugaccaagaaggacaacgcguaccccacgaucaagcgcucguacaacaacaccaaccaggaggaccugcugguccucugggggauccaccaccccaacgacgccgccgagcagacccggcuguaccagaacccgaccacguacaucuccgugggcaccucgacccugaaccagcgccucgugcccaagaucgccacccgguccaaggucaacgggcagagcggccgcauggaguucuucuggacgauccugaagcccaacgacgcgaucaacuucgaguccaacgggaacuucaucgcccccgagaacgccuacaagaucgugaagaagggcgacucgaccaucaugaaguccgagcuggaguacggcaacugcaacaccaagugccagaccccgaucggggccaucaacagcucgaugcccuuccacaacauccacccccucacgaucggcgagugccccaaguacgugaaguccaaccggcugauccuggccaccgggcuccgcaacagcccgcagggcgagcggcgccggaagaagcgcggccuguucggggcgaucgccggcuucaucgagggcggguggcaggggauggucgacggcugguacggcuaccaccacuccaacgagcaggggucgggcuacgccgccgacaaggaguccacccagaaggccaucgacggggugaccaacaaggugaacucgaucaucgacaagaugaacacgcaguucgaggcggucggccgggaguucaacaaccuggagcgccggaucgagaaccucaacaagaagauggaggacggguuccuggacguguggaccuacaacgccgagcugcucgugcugauggagaacgagcgcacccuggacuuccacgacuccaacgucaagaaccucuacgacaaggugcggcugcagcugcgcgacaacgccaaggagcucggcaacggcugcuucgaguucuaccaccggugcgacaacgagugcauggagagcguccgcaacgggaccuacgacuacccccaguacuccgaggaggcccgccugaagcgggaggagaucucgggcgugaagcuggaguccaucgggacguaccagauccucagcaucuacuccaccguggccucgucccuggcgcuggccaucauggucgccggccucuuccuguggaugugcagcaacgggucccugcagugccgcaucugcaucuga

SEQ ID NO: 3241 - RNA, 1704 nt, Artificial Sequence; identical to SEQ ID NO: 3237
  derived and/or modified CDS sequence (AUadapt) from InfluenzaA__ACT15343__HA

SEQ ID NO: 3242 - RNA, 1704 nt, Artificial Sequence
  derived and/or modified CDS sequence (AUadapt) from InfluenzaA__ACT15345__HA
auggagaagaucgugcugcuccuggccaucgucucgcuggugaaguccgaccagaucugcaucggcuaccacgccaacaacucgaccgagcaggucgacaccaucauggagaagaacgugacggugacccacgcgcaggacauccucgagaagacccacaacgggaagcugugcaaccuggacggcgugaagccccucauccugcgcgacugcuccgucgccggguggcugcucggcaacccgaugugcgacgaguuccugaacgugcccgaguggagcuacaucguggagaagaucaaccccgccaacgaccugugcuaccccgggaacuucaacgacuacgaggagcucaagcaccuccugucccggaucaaccacuucgagaagauccagaucaucccgaagaacucgugguccgaccacgaggccagcggcgucuccucguccugccccuaccagggccgcagcuccuucuuccggaacgugguguggcucaccaagaaggacaacgccuaccccacgaucaagcgcucguacaacaacaccaaccaggaggaccugcugguccucugggggauccaccaccccaacgacgcggccgagcagacccggcuguaccagaacccgaccacguacaucuccgugggcaccagcacccugaaccagcgccucgugcccaagaucgccacccgguccaaggucaacgggcagucgggccgcauggaguucuucuggacgauccugaaguccaacgacgccaucaacuucgggagcaacggcaacuucaucgcgcccgagaacgccuacaagaucgugaagaagggcgacucgaccaucaugaaguccgagcuggaguacgggaacugcaacaccaagugccagacccccaucggcgccaucaacucguccaugccguuccacaacauccacccccucacgaucggggagugccccaaguacgugaaguccaaccggcugguccuggccaccggccuccgcaacagcccccagggcgagcggcgccggaagaagcgcgggcuguucggcgccaucgcgggguucaucgagggcggguggcagggcaugguggacggcugguacggguaccaccacucgaacgagcagggcuccggguacgccgccgacaaggagagcacccagaaggccaucgacggcgugaccaacaaggucaacuccaucaucgacaagaugaacacgcaguucgaggccguggggcgggaguucaacaaccuggagcgccggaucgagaaccucaacaagaagauggaggacggcuuccuggacguguggaccuacaacgcggagcugcucguccugauggagaacgagcgcacccuggacuuccacgacucgaacgugaagaaccucuacgacaagguccggcugcagcugcgcgacaacgccaaggagcucggcaacgggugcuucgaguucuaccaccggugcgacaacgagugcauggaguccgugcgcaacggcaccuacgacuacccgcaguacagcgaggaggcccgccugaagcgggaggagaucuccggggugaagcuggagucgaucggcacguaccagauccucuccaucuacagcaccgucgccuccucgcuggcccuggcgaucaugguggccgggcuguuccuguggaugugcuccaacggcagccugcagugccgcaucugcaucuga

SEQ ID NO: 3243 - RNA, 1707 nt, Artificial Sequence
  derived and/or modified CDS sequence (AUadapt) from InfluenzaA__ACT15347__HA
auggagaagaucgugcugcuccuggccaucgucucgcuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguuccugaacgugcccgaguggucguacaucguggagaagaucaaccccgccaacgaccugugcuaccccggggacuucaacgacuacgaggagcucaagcaccuccugucccggaucaaccacuucgagaagauccagaucauccccaagagcuccuggucggaccacgaggccuccagcggcgucuccucggccugcccguaccagggccgcuccagcuucuuccggaacgugguguggcugaucaagaaggacaacgcguaccccaccaucaagcgcuccuacaacaacacgaaccaggaggaccugcugguccucugggggauccaccaccccaacgacgccgccgagcagacccggcuguaccacaacccgaccaccuacaucagcgugggcacguccacccugaaccagcgccucgugcccaagaucgccacccggucgaaggucaacgggcaguccggccgcauggaguucuucuggaccauccugaagcccaacgacgcgaucaacuucgagagcaacgggaacuucaucgcccccgagaacgccuacaagaucgugaagaagggcgacucgacgaucaugaaguccgagcuggaguacggcaacugcaacaccaagugccagaccccgaucggggccaucaacagcuccaugcccuuccacaacauccacccccucaccaucggcgagugccccaaguacgucaagucgucccggcuggugcuggccacggggcuccgcaacagcccgcagggcaagaaccggcgcaagaagcggggccuguucggggcgaucgccggcuucaucgagggcggguggcaggggaugguggacggcugguacggcuaccaccacuccaacgagcaggggagcggcuacgccgccgacaaggaguccacccagcgcgccaucgacggggugaccaacaaggucaacucgaucaucgacaagaugaacacccaguucgaggcggugggccgggaguucaacaaccuggagcgccggaucgagaaccucaacaagaagauggaggacggguuccuggacguguggacguacaacgccgagcugcucguccugauggagaacgagcgcacccuggacuuccacgacuccaacgugaagaaccucuacgacaagguccggcugcagcugcgcgacaacgccaaggagcucggcaacggcugcuucgaguucuaccaccggugcgacaacgagugcauggagagcgugcgcaacgggaccuacgacuacccccaguacuccgaggaggcccgccugaagcgggaggagaucucgggcgugaagcuggaguccaucgggaucuaccagauccucagcaucuacuccaccgucgccucgucccuggcgcuggccaucaugguggccggccucuuccuguggaugugcagcaacgggagccugcagugccgcaucugcaucuga

SEQ ID NO: 3244 - RNA, 1704 nt, Artificial Sequence
  derived and/or modified CDS sequence (AUadapt) from InfluenzaA__ACT15349__HA
auggagaagaucgugcugcuccuggccaucgucucgcuggugaaguccgaccagaucugcaucggcuaccacgccaacaacucgaccgagcaggucgacaccaucauggagaagaacgugacggugacccacgcgcaggacauccucgagaagacccacaacgggaagcugugcaaccuggacggcgugaagccccucauccugcgcgacugcuccgucgccggguggcugcucggcaacccgaugugcgacgaguuccugaacgugcccgaguggagcuacaucguggagaagaucaaccccgccaacgaccugugcuaccccgggaacuucaacgacuacgaggagcucaagcaccuccugucccggaucaaccacuucgagaagauccagaucaucccgaagaacucgugguccgaccacgaggccagcggcgucuccucggccugccccuaccagggccgcuccagcuucuuccggaacgugguguggcucaccaagaaggacaacgcguaccccacgaucaagcgcuccuacaacaacaccaaccaggaggaccugcugguccucugggggauccaccaccccaacgacgccaccgagcagacccggcuguaccagaacccgacgaccuacaucucggugggcaccuccacccugaaccagcgccucauccccaagaucgccacgcggucgaaggugaacgggcaguccggccgcauggaguucuucuggaccauccucaagagcaacgacgccaucaacuucgaguccaacgggaacuucaucgcgcccgagaacgccuacaagaucgucaagaagggcgacucgaccaucaugaaguccgagcuggaguacggcaacugcaacaccaagugccagacgcccaucggggccaucaacagcucgaugccguuccacaacauccacccccugaccaucggcgagugccccaaguacgugaaguccaaccggcuggugcuggccaccgggcuccgcaacagcccccaggaggagcggcgccggaagaagcgcggccuguucggcgccaucgcgggguucaucgagggcggguggcagggcauggucgacgggugguacggcuaccaccacuccaacgagcagggcucgggguacgccgccgacaaggaguccacccagaaggccaucgacggcgugacgaacaaggugaacucgaucaucgacaagaugaacacccaguucgaggccgucgggcgggaguucaacaaccuggagcgccggaucgagaaccucaacaagaagauggaggacggcuuccuggacguguggaccuacaacgcggagcugcucgugcugauggagaacgagcgcacccuggacuuccacgacuccaacgucaagaaccucuacgacaaggugcggcugcagcugcgcgacaacgccaaggagcucgggaacggcugcuucgaguucuaccaccggugcgacaacgagugcauggagagcguccgcaacggcacguacgacuacccgcaguacuccgaggaggcccgccugaagcgggaggagaucucgggggugaagcuggaguccaucggcaccuaccagauccucagcaucuacuccaccguggccucgucccuggcccuggcgaucauggucgccgggcuguuccuguggaugugcagcaacggcucccugcagugccgcaucugcaucuga

SEQ ID NO: 3245 - RNA, 1707 nt, Artificial Sequence
  derived and/or modified CDS sequence (AUadapt) from InfluenzaA__ACT15351__HA
auggagaagaucgugcugcuccuggccaucgucucgcuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguuccugaacgugcccgaguggucguacaucguggagaagaucaaccccgccaacgaccugugcuaccccggggacuucaacgacuacgaggagcucaagcaccuccugucccggaucaaccacuucgagaagauccagaucauccccaagagcuccuggagcgaccacgaggccuccucgggcgucuccagcgccugcccguaccagggcggguccucguucuuccgcaacgugguguggcucaucaagaaggacaacgcguaccccaccaucaagcgguccuacaacaacacgaaccaggaggaccugcugguccucuggggcauccaccaccccaacgacgccgccgagcagacccgccuguaccacaacccgaccaccuacaucagcguggggacguccacccugaaccagcggcucgugcccaagaucgccacccgcagcaaggucaacggccaguccgggcggauggaguucuucuggaccauccugaagcccaacgacgcgaucaacuucgagucgaacggcaacuucaucgcccccgagaacgccuacaagaucgugaagaagggcgacagcacgaucaugaaguccgagcuggaguacgggaacugcaacaccaagugccagaccccgaucggcgccaucaacucguccaugcccuuccacaacauccacccccucaccaucggggagugccccaaguacgucaagagcucccgccuggugcuggccacgggccuccggaacagcccgcagggcaagucccgccggaagaagcgcgggcuguucggcgcgaucgccggguucaucgagggcggguggcagggcaugguggacggcugguacggguaccaccacucgaacgagcagggcuccggguacgccgccgacaaggagagcacccagcgggccaucgacggcgugaccaacaaggucaacuccaucaucgacaagaugaacacccaguucgaggcgguggggcgcgaguucaacaagcuggagcggcgcaucgagaaccucaacaagaagauggaggacggcuuccuggacguguggacguacaacgccgagcugcucguccugauggagaacgagcggacccuggacuuccacgacucgaacgugaagaaccucuacgacaagguccgccugcagcugcgggacaacgccaaggagcucggcaacgggugcuucgaguucuaccaccgcugcgacaacgagugcauggaguccgugcggaacggcaccuacgacuacccccaguacagcgaggaggcccgccugaagcgcgaggagaucuccggggugaagcuggagagcaucggcaucuaccagauccucuccaucuacucgaccgucgccuccagccuggcgcuggccaucaugguggccgggcuguuccuguggaugugcagcaacggcucccugcagugccggaucugcaucuga

SEQ ID NO: 3246 - RNA, 1704 nt, Artificial Sequence
  derived and/or modified CDS sequence (AUadapt) from InfluenzaA__ACT15353__HA
auggagaagaucgugcugcuccuggccaucgucucgcuggugaaguccgaccagaucugcaucggcuaccacgccaacaacucgaccgagcaggucgacaccaucauggagaagaacgugacggugacccacgcgcaggacauccucgagaagacccacaacgggaagcugugcaaccuggacggcgugaagccccucauccugcgcgacugcuccgucgccggguggcugcucggcaacccgaugugcgacgaguuccugaacgugcccgaguggagcuacaucguggagaagaucaaccccgccaacgaccugugcuaccccgggaacuucaacgacuacgaggagcucaagcaccuccugucccggaucaaccacuucgagaagauccagaucaucccgaagaacucgugguccgaccacgaggccagcggcgucuccucggccugccccuaccagggccgcuccagcuucuuccggaacgugguguggcucaccaagaagaacuccgcguaccccacgaucaagcgcucguacaacaacaccaaccaggaggaccugcugguccucugggggauccaccaccccaacgacgccgccgagcagacccggcuguaccagaacccgaccacguacaucuccgugggcaccagcacccugaaccagcgccucgugcccaagaucgccacccgguccaaggucaacgggcagucgggccgcauggaguucuucuggacgauccugaaguccaacgacgcgaucaacuucgagagcaacgggaacuucaucgcccccgagaacgccuacaagaucgugaagaagggcgacucgaccaucaugaaguccgagcuggaguacagcaacugcaacaccaagugccagacccccaucggcgccaucaacuccucgaugccguuccacaacauccacccccucacgaucggggagugccccaaguacgugaaguccaaccggcugguccuggccaccggccuccgcaacagcccccagggggagcggcgccggaagaagcgcggccuguucggcgcgaucgccggguucaucgagggcggguggcagggcaugguggacgggugguacggcuaccaccacuccaacgagcagggcucgggguacgccgccgacaaggaguccacccagaaggccaucgacggcgugaccaacaaggucaacagcaucaucgacaagaugaacacgcaguucgaggcgguggggcgggaguucaacaaccuggagcgccggaucgagaaccucaacaagaagauggaggacggcuuccuggacguguggaccuacaacgccgagcugcucguccugauggagaacgagcgcacccuggacuuccacgacuccaacgugaagaaccucuacgacaagguccggcugcagcugcgcgacaacgccaaggagcucgggaacggcugcuucgaguucuaccaccggugcgacaacgagugcauggagucggugcgcaacggcaccuacgacuacccgcaguacuccgaggaggcccgccugaagcgggaggagaucagcggggugaagcuggaguccaucggcacguaccagauccucucgaucuacuccaccgucgccagcucccuggcgcuggccaucaugguggccgggcuguuccuguggaugugcucgaacggcagccugcagugccgcaucugcaucuga

SEQ ID NO: 3247 - RNA, 1707 nt, Artificial Sequence
  derived and/or modified CDS sequence (AUadapt) from InfluenzaA__ACT15355__HA
auggagaagaucgugcugcuccuggccaucgucucgcuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguuccugaacgugcccgaguggucguacaucguggagaagaucaaccccgccaacgaccugugcuaccccggggacuucaacgacuacgaggagcucaagcaccuccugucccggaucaaccacuucgagaagauccagaucauccccaagagcuccuggagcgaccacgaggccuccucgggcgucuccagcgccugcccguaccagggccgcuccucguucuuccggaacgugguguggcugaucaagaaggacaacgcguaccccaccaucaagcgcuccuacaacaacacgaaccaggaggaccugcugguccucugggggauccaccaccccaacgacgccgccgagcagacccggcuguaccacaacccgaccaccuacaucagcgugggcacguccacccugaaccagcgccucgugcccaagaucgccacccggagcaaggucaacgggcaguccggccgcauggaguucuucuggaccauccugaagcccaacgacgcgaucaacuucgagucgaacgggaacuucaucgcccccgagaacgccuacaagaucgugaagaagggcgacagcacgaucaugaaguccgagcuggaguacggcaacugcaacaccaagugccagaccccgaucggggccaucaacucguccaugcccuuccacaacauccacccccucaccaucggcgagugccccaaguacgucaagagcucccggcuggugcuggccacggggcuccgcaacagcccgcagggcaagucccggcgcaagaagcggggccuguucggggcgaucgccggcuucaucgagggcggguggcaggggaugguggacggcugguacggcuaccaccacucgaacgagcagggguccggcuacgccgccgacaaggagagcacccagcgcgccaucgacggggugaccaacaaggucaacuccaucaucgacaagaugaacacccaguucgaggcggugggccgggaguucaacaaccuggagcgccggaucgagaaccucaacaagaagauggaggacggguuccuggacguguggacguacaacgccgagcugcucguccugauggagaacgagcgcacccuggacuuccacgacucgaacgugaagaaccucuacgacaagguccggcugcagcugcgcgacaacgccaaggagcucggcaacggcugcuucgaguucuaccaccggugcgacaacgagugcauggaguccgugcgcaacgggaccuacgacuacccccaguacagcgaggaggcccgccugaagcgggaggagaucuccggcgugaagcuggagagcaucgggaucuaccagauccucuccaucuacucgaccgucgccuccagccuggcgcuggccaucaugguggccggccucuuccuguggaugugcagcaacgggucccugcagugccgcaucugcaucuga

SEQ ID NO: 3248 - RNA, 1704 nt, Artificial Sequence
  derived and/or modified CDS sequence (AUadapt) from InfluenzaA__ACT15357__HA
auggagaagaucgugcugcuccuggccaucgucucgcuggugaaguccgaccagaucugcaucggcuaccacgccaacaacucgaccgagcaggucgacaccaucauggagcgcaacgugacggugacccacgcgcaggacauccucgagaagacccacaacgggaagcugugcaaccuggacggcgugaagccccucauccugcgggacugcuccgucgccggguggcugcucggcaacccgaugugcgacgaguuccugaacgugcccgaguggagcuacaucguggagaagaucaaccccgccaacgaccugugcuaccccgggaacuucaacgacuacgaggagcucaagcaccuccugucccgcaucaaccacuucgagaagauccagaucaucccgaagaacucgugguccgaccacgaggccagcggcgucuccucggccugccccuaccagggccgguccagcuucuuccgcaacgugguguggcugacccagaaggacaacgcguaccccacgaucaagcgguccuacaacaacaccaaccaggaggaccugcugguccucugggggauccaccaccccaacgacgccgccgagcagacccgccuguaccagaacccgaccacguacaucucggugggcaccuccacccugaaccagcggcucauccccaagaucgccacccgcucgaaggugaacgggcaguccggccggauggaguucuucuggacgauccucaagagcaacgacgcgaucaacuucgaguccaacgggaacuucaucgcccccgagaacgccuacaagaucgucaagaagggcgacucgaccaucaugaaguccgagcuggaguacggcaacugcaacaccaagugccagacccccaucggggccaucaacagcucgaugccguuccacaacauccacccccugacgaucggcgagugccccaaguacgugaaguccaaccgccuggugcuggccaccgggcuccggaacagcccccagggcgagcgccggcgcaagaagcggggccuguucggggcgaucgccggcuucaucgagggcggguggcaggggauggucgacggcugguacggcuaccaccacuccaacgagcaggggucgggcuacgccgccgacaaggaguccacccagaaggccaucgacggggugaccaacaaggugaacucgaucaucgacaagaugaacacgcaguucgaggcggucggccgcgaguucaacaaccuggagcggcgcaucgagaaccucaacaagaagauggaggacggguuccuggacguguggaccuacaacgccgagcugcucgugcugauggagaacgagcggacccuggacuuccacgacuccaacgucaagaaccucuacgacaaggugcgccugcagcugcgggacaacgccaaggagcucggcaacggcugcuucgaguucuaccaccgcugcgacaacgagugcauggagagcguccgcaacgggaccuacgacuacccgcaguacuccgaggaggcccggcugaagcgcgaggagaucucgggcgugaagcuggaguccaucgggacguaccagauccucagcaucuacuccaccguggccucgucccuggcgcuggccaucauggucgccggccucuuccuguggaugugcagcaacgggucccugcagugccggaucugcaucuga

SEQ ID NO: 3249 - RNA, 1701 nt, Artificial Sequence
  derived and/or modified CDS sequence (AUadapt) from InfluenzaA__ACT20200__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcuccucgcgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccucgcugcccuuccagaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcucgggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 3250 - RNA, 1701 nt, Artificial Sequence
  derived and/or modified CDS sequence (AUadapt) from InfluenzaA__ACT21466__HA
augaagaccaucaucgcccugucguacauccucugccugguguucgcccagaagcugcccggcaacgacaacuccaccgcgacgccgugccucgggcaccacgccguccccaacggcacccuggugaagaccaucaccaacgaccagaucgaggugacgaacgccaccgagcugguccagucguccagcaccgggaagaucugcgacucgccccaccgcauccucgacggcaagaacugcacccugaucgacgcccugcucggggacccccacugcgacggcuucaagaacaaggagugggaccuguucguggagcggagcacggccuacuccaacugcuacccguacgacgugcccgacuacgcgucgcugcgcucccucgucgccagcuccggcacccuggaguucaccaacgagggguucaacuggaccggcguggcccaggacgggacgucguacgccugcaagcggggcuccgugaaguccuucuucucccgccugaacuggcuccacaagcuggaguacaaguaccccgcgcugaacgucaccaugcccaacaacgacaaguucgacaagcucuacaucuggggcgugcaccacccgagcaccgacuccgaccagaccucgcuguacgugcaggccuccgggcgggucacggugagcaccaagcgcucgcagcagaccgugauccccaacaucggcucccggcccuggguccgcgggaucucgucccggaucagcaucuacuggaccaucgugaagcccggcgacauccugcucaucaacuccacggggaaccugaucgccccgcgcggcuacuucaagauccggucgggcaaguccagcaucaugcgcuccgacgcccccaucgacaacugcaacucggagugcaucacccccaacggguccauccccaacgacaagccguuccagaacgugaaccggaucaccuacggcgccugcccccgcuacgucaagcagaacacccugaagcucgcgacggggaugcggaacgugcccgagaagcagacccgcggcaucuucggggccaucgccggcuucaucgagaacggcugggaggggaugguggacggcugguacggguuccggcaccagaacagcgagggcaccgggcaggccgccgaccugaaguccacccaggcggccaucaaccagaucaacggcaagcugaaccgccucaucgagaagacgaacgagaaguuccaccagaucgagaaggaguucucggaggucgagggccggauccaggaccuggagaaguacguggaggacaccaagaucgaccugugguccuacaacgccgagcuccugguggcccuggagaaccagcacaccaucgaccucaccgacagcgagaugaacaagcuguucgagaagacgcgcaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaaggggguggagcucaagucgggcuacaaggacuggauccuguggaucuccuucgccaucagcugcuuccugcugugcgucgugcugcucggcuucaucaugugggccugccagaaggggaacauccgcugcaacaucugcaucuga

SEQ ID NO: 3251 - RNA, 1701 nt, Artificial Sequence
  derived and/or modified CDS sequence (AUadapt) from InfluenzaA__ACT21467__HA
augaagaccaucaucgcccugucguacauccucugccugguguucgcccagaagcugcccggcuccgacaacagcaccgcgacgcucugccuggggcaccacgccgucccgaacggcacccuggugaagaccaucaccaacgaccagaucgaggugacgaacgccaccgagcucguccaguccucguccaccgggaagaucugcgacagcccccaccgcauccuggacggcaagaacugcacccugaucgacgcccuccugggggacccccacugcgacggcuucaagaacaaggagugggaccuguucguggagcgguccacggccuacucgaacugcuaccccuacgacgugccggacuacgcgucccuccgcagccuggucgccuccucgggcacccuggaguucaccaacgagggguucaacuggaccggcguggcccaggacgggacguccuacgccugcaagcggggcagcgugaaguccuucuucucgcgccucaacuggcugcacaagcuggaguacaaguaccccgcgcucaacgucaccaugcccaacaacgacaaguucgacaagcuguacaucuggggcgugcaccaccccuccaccgacagcgaccagaccucccuguacgugcaggccucggggcgggucacggugagcaccaagcgcucccagcagaccgugaucccgaacaucggcucgcggcccuggguccgcgggaucuccagccggaucuccguguacuggaccaucgugaagccccgcgacauccuccugaucaacucgacgggcaaccugaucgcgccccggggguacuucaagauccgcuccggcaagagcuccaucaugcggucggacgccccgaucgacaacugcaacuccgagugcaucacccccaacggcagcauccccaacgacaagcccuuccagaacgucaaccgcaucaccuacggggccugcccgcgguacgugaagcagaacacccucaagcuggccacgggcaugcgcaacgugcccgagaagcagacccgggggaucuucggcgccaucgccggguucaucgagaacggcugggagggcauggucgacgggugguacggcuuccgccaccagaacuccgaggggaccggccaggccgccgaccucaagucgacccaggcggccaucaaccggaucaacgggaagcugaaccgccugaucgagaagacgaacgagaaguuccaccagaucgagaaggaguucuccgagguggagggccggauccaggaccuggagaaguacguggaggacaccaagaucgaccucuggagcuacaacgccgagcugcuggucgcccucgagaaccagcacaccaucgaccugaccgacuccgagaugaacaagcuguucgagaagacgcgcaagcagcuccgcgagaacgccgaggacaugggcaacgggugcuucaagaucuaccacaagugcgacaacgcgugcaucggcucgauccggaacgggaccuacgaccacgacguguaccgcgacgaggcccugaacaaccgguuccagaucaagggcgucgagcugaaguccggguacaaggacuggauccucuggaucagcuucgccaucagcugcuuccugcugugcguggugcuccugggcuucaucaugugggccugccagaagggcaacauccgcugcaacaucugcaucuga

SEQ ID NO: 3252 - RNA, 1701 nt, Artificial Sequence
  derived and/or modified CDS sequence (AUadapt) from InfluenzaA__ACT21468__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggaagaucugcgacagcccccaccgcauccuggacggcaagaacugcacccugaucgacgcccuccugggggacccccacugcgacggcuucaagaacaaggagugggaccuguucguggagcggucgacggccuacuccaacugcuaccccuacgacgugccggacuacgcgagccuccgcucccuggucgccucguccggcacccuggaguucaccaacgagggguucaacuggaccggcguggcccaggacgggacgagcuacgccugcaagcggggcuccgugaaguccuucuucucccgccucaacuggcugcacaagcuggaguacaaguaccccgcgcucaacgucaccaugcccaacaacgacaaguucgacaagcuguacaucuggggcgugcaccaccccucgaccgacuccgaccagaccagccuguacgugcaggccuccgggcgggucacggugagcaccaagcgcucgcagcagaccgugaucccgaacaucggcucccggcccuggguccgcgggaucagcucccggaucucgaucuacuggaccaucgugaagcccggcgacauccuccugaucaacuccacggggaaccugaucgcgccccgcggcuacuucaagauccggagcggcaaguccucgaucaugcgcuccgacgccccgaucgacaacugcaacagcgagugcaucacccccaacggguccauccccaacgacaagcccuuccagaacgugaaccggaucaccuacggcgccugcccgcgcuacgucaagcagaacacccucaagcuggccacggggaugcggaacgugcccgagaagcagacccgcggcaucuucggggccaucgccggcuucaucgagaacggcugggaggggaugguggacggcugguacggguuccggcaccagaacucggagggcaccgggcaggccgccgaccugaaguccacccaggcggccaucaaccagaucaacggcaagcucaaccgccugaucgagaagacgaacgagaaguuccaccagaucgagaaggaguucagcgaggucgagggccggauccaggaccuggagaaguacguggaggacaccaagaucgaccucugguccuacaacgccgagcugcugguggcccucgagaaccagcacaccaucgaccugaccgacucggagaugaacaagcuguucgagaagacgcgcaagcagcuccgggagaacgucgaggacauggggaacggcugcuucaagaucuaccacaagugcgacaacgccugcaucggguccauccgcaacggcaccuacgaccacgacguguaccgcgacgaggcgcugaacaaccgguuccagaucaagggggucgagcucaagagcggcuacaaggacuggauccuguggaucuccuucgccaucagcugcuuccugcugugcguggugcuccugggcuucaucaugugggccugccagaaggggaacauccgcugcaacaucugcaucuga

SEQ ID NO: 3253 - RNA, 1701 nt, Artificial Sequence
  derived and/or modified CDS sequence (AUadapt) from InfluenzaA__ACT21469__HA
augaagaccaucaucgcccugucguacaucucccgccucguguucgcccagaagcugcccggcaacgacaacucgaccgcgacgcugugccucgggcaccacgccgucccgaacggcacccuggugaagaccaucaccaacgaccagaucgaggugacgaacgccaccgagcugguccaguccagcuccaccgggcggaucugcgacucgccccaccgcauccucgacggcgagaacugcacccugaucgacgcccugcucggggacccccacugcgacggcuuccagaacaaggagugggaccuguucguggagcgguccaaggccuacagcaacugcuaccccuacgacgugccggacuacgcgucccugcgcucgcucgucgccuccagcggcacgcuggaguucaacaacgaguccuucaacuggaccgggguggcccaggacggcaccucguacgccugcaagcggcgcuccaucaagucguucuucucccggcugaacuggcuccaccagcugaaguacaaguaccccgcgcugaacgugaccaugcccaacaacgacaaguucgacaagcucuacaucuggggcguccaccaccccagcacggacuccgaccagaccucgcuguacgcccaggccagcgggcgcgugaccguguccaccaagcggucgcagcagacggucaucccgaacaucgggucccgccccugggugcggggcgugagcucccgcaucucgaucuacuggaccaucgucaagcccggcgacauccugcucaucaacuccaccgggaaccugaucgcgccccggggcuacuucaagauccgcucggggaaguccagcaucaugcgguccgacgccccgaucggcaagugcaacucggagugcaucacccccaacggcuccauccccaacgacaagcccuuccagaacgugaaccgcaucacguacggggccugcccgcgguacgugaagcagaacacccugaagcucgccaccggcaugcgcaacguccccgagaagcagacccgggggaucuucggcgccaucgccggguucaucgagaacggcugggagggcaugguggacgggugguacggcuuccgccaccagaacagcgaggggacgggccaggccgcggaccugaaguccacccaggccgccaucaaccagaucaacgggaagcugaaccggcucaucgagaagaccaacgagaaguuccaccagaucgagaaggaguucucggagguggagggccgcauccaggaccuggagaaguacgucgaggacaccaagaucgaccugugguccuacaacgccgagcuccugguggcccuggagaaccagcacacgaucgaccucaccgacagcgagaugaacaagcuguucgagcgcacccggaagcagcugcgcgagaacgcggaggacaugggcaacgggugcuucaagaucuaccacaagugcgacaacgccugcaucggcuccauccggaacgggaccuacgaccacgacguguaccgcgacgaggcccucaacaaccgguuccagaucaagggcgucgagcucaagucgggguacaaggacuggauccuguggaucagcuucgccaucuccugcuuccugcugugcgugguccugcucggcuucaucaugugggccugccagaagggcaacauccgcugcaacaucugcaucuga

SEQ ID NO: 3254 - RNA, 1701 nt, Artificial Sequence
  derived and/or modified CDS sequence (AUadapt) from InfluenzaA__ACT21471__HA
augaagaccaucaucgcccugucguacaucuccugccucguguucgcccagaagcugcccggcaacgacaacucgaccgcgacgcugugccucgggcaccacgccgucccgaacggcacccuggugaagaccaucaccaacgaccagaucgaggugacgaacgccaccgagcugguccaguccagcuccaccgggcgcaucugcgacucgccccaccggauccucgacggcgagaacugcacccugaucgacgcccugcucggggacccccacugcgacggcuuccagaacaaggagugggaccuguucguggagcgcuccaaggccuacagcaacugcuaccccuacgacgugccggacuacgcgucccugcggucgcucgucgccuccagcggcacgcuggaguucaacaacgaguccuucaacuggaccgggguggcccaggacggcaccucguacgccugcaagcgccgguccaucaagagcuucuucucccgccugaacuggcuccaccagcugaaguacaaguaccccgcgcugaacgugaccaugcccaacaacgacaaguucgacaagcucuacaucuggggcguccaccaccccucgacggacuccgaccagaccagccuguacgcccaggccucggggcgggugaccguguccaccaagcgcagccagcagacggucaucccgaacaucgggucccggcccugggugcgcggcgugucgucccggaucagcaucuacuggaccaucgucaagcccggcgacauccugcucaucaacuccaccgggaaccugaucgcgccccgcggcuacuucaagauccggucggggaaguccagcaucaugcgcuccgacgccccgaucggcaagugcaacucggagugcaucacccccaacggcuccauccccaacgacaagcccuuccagaacgugaaccggaucacguacggggccugcccgcgcuacgugaagcagaacacccugaagcucgccaccggcaugcggaacguccccgagaagcagacccgcgggaucuucggcgccaucgccggguucaucgagaacggcugggagggcaugguggacgggugguacggcuuccggcaccagaacagcgaggggacgggccaggccgcggaccugaaguccacccaggccgccaucaaccagaucaacgggaagcugaaccgccucaucgagaagaccaacgagaaguuccaccagaucgagaaggaguucucggagguggagggccggauccaggaccuggagaaguacgucgaggacaccaagaucgaccugugguccuacaacgccgagcuccugguggcccuggagaaccagcacacgaucgaccucaccgacagcgagaugaacaagcuguucgagcgcacccgcaagcagcugcgggagaacgcggaggacaugggcaacgggugcuucaagaucuaccacaagugcgacaacgccugcaucggcuccauccgcaacgggaccuacgaccacgacguguaccgggacgaggcccucaacaaccgcuuccagaucaagggcgucgagcucaagucgggguacaaggacuggauccuguggaucagcuucgccaucuccugcuuccugcugugcgugguccugcucggcuucaucaugugggccugccagaagggcaacauccggugcaacaucugcaucuga

SEQ ID NO: 3255 - RNA, 1701 nt, Artificial Sequence
  derived and/or modified CDS sequence (AUadapt) from InfluenzaA__ACT21472__HA
augaagaccaucaucgcccugucguacaucuccugccucguguucgcccagaagcugcccggcaacgacaacucgaccgcgacgcugugccucgggcaccacgccgucccgaacggcacccuggugaagaccaucaccaacgaccagaucgaggugacgaacgccaccgagcugguccaguccagcuccaccgggcgcaucugcgacucgccccaccggauccucgacggcgagaacugcacccugaucgacgcccugcucggggacccccacugcgacggcuuccagaacaaggagugggaccuguucguggagcgcuccaaggccuacagcaacugcuaccccuacgacgugccggacuacgcgucccugcggucgcucgucgccuccagcggcacgcuggaguucaacaacgaguccuucaacuggaccgggguggcccaggacggcaccucguacgccugcaagcgccgguccaucaagagcuucuucuccacccugaacuggcuccaccagcugaaguacaaguaccccgcgcugaacgugacgaugcccaacaacgacaaguucgacaagcucuacaucuggggcguccaccaccccucgaccgacuccgaccagaccagccuguacgcccaggccucggggcgcgugaccguguccacgaagcggagccagcagaccgucaucccgaacaucgggucccgccccugggugcggggcgugucgucccgcaucagcaucuacuggaccaucgucaagcccggcgacauccugcucaucaacuccaccgggaaccugaucgcgccccggggcuacuucaagauccgcucggggaaguccagcaucaugcgguccgacgccccgaucggcaagugcaacucggagugcaucacgcccaacggcuccauccccaacgacaagcccuuccagaacgugaaccgcaucaccuacggggccugcccgcgguacgugaagcagaacacccugaagcucgccaccggcaugcgcaacguccccgagaagcagacgcgggggaucuucggcgccaucgccggguucaucgagaacggcugggagggcaugguggacgggugguacggcuuccgccaccagaacagcgaggggaccggccaggccgcggaccugaaguccacccaggccgccaucaaccagaucaacgggaagcugaaccggcucaucgagaagaccaacgagaaguuccaccagaucgagaaggaguucucggagguggagggccgcauccaggaccuggagaaguacgucgaggacacgaagaucgaccugugguccuacaacgccgagcuccugguggcccuggagaaccagcacaccaucgaccucaccgacagcgagaugaacaagcuguucgagcggacccgcaagcagcugcgcgagaacgcggaggacaugggcaacgggugcuucaagaucuaccacaagugcgacaacgccugcaucggcuccauccggaacgggacguacgaccacgacguguaccgcgacgaggcccucaacaaccgguuccagaucaagggcgucgagcucaagucgggguacaaggacuggauccuguggaucagcuucgccaucuccugcuuccugcugugcgugguccugcucggcuucaucaugugggccugccagaagggcaacauccgcugcaacaucugcaucuga

SEQ ID NO: 3256 - RNA, 1701 nt, Artificial Sequence
  derived and/or modified CDS sequence (AUadapt) from InfluenzaA__ACT21507__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaaccgcacccugaucgacgcccugcucggcgacccccagugcgacggcuuccagaacaagaagugggaccuguucguggagcggucgaaggccuacuccaacugcuaccccuacgacgugccggacuacgcgagccugcgcucccucgucgccucguccgggacgcuggaguucaacaacgagucguucaacuggaccggcgugacccagaacgggaccuccagcgccugcaagggccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucaccgugucgacgaagcgcucgcagcagaccgugaucccgaacaucgggucccggccccgcguccgggacauccccagccgcaucuccaucuacuggaccaucgugaagcccggcgacauccugcucaucaacucgaccgggaaccugaucgccccgcggggcuacuucaagauccgcuccggcaagucguccaucaugcggagcgacgcccccaucgggaagugcaacuccgagugcaucacgcccaacggcucgauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggcuucaucgagaacgggugggagggcaugguggacgggugguacggcuuccgccaccagaacuccgaggggaucggccaggccgccgaccugaaguccacccaggcggccaucaaccagaucaacggcaagcugaaccggcucaucgggaagaccaacgagaaguuccaccagaucgagaaggaguucuccgaggucgagggccgcauccaggaccuggagaaguacguggaggacacccggaucgaccuguggucguacaacgccgagcuccugguggcccuggagucccagcacacgaucgaccucaccgacagcgagaugaacaagcuguucgagcgcaccaagaagcagcugcgcgagaacgccgaggacauggggaacggcugcuucaagaucuaccacaagugcgacaacgcgugcaucggguccauccggaacggcaccuacgaccacgacgucuaccgcgacgaggcccucaacaagcgguuccagaucaagggcguggagcucaagucgggguacaaggacuggauccuguggaucuccuucgccaucagcugcuuccugcugugcguggcccugcucggcuucaucaugugggccugccagaaggggaacauccgcugcaacaucugcaucuga

SEQ ID NO: 3257 - RNA, 1701 nt, Artificial Sequence
  derived and/or modified CDS sequence (AUadapt) from InfluenzaA__ACT21508__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagagcuucaacuggaccggcgugacccagaacgggaccuccucggccugcaagcgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucaccgugucgacgaagcgcucgcagcagaccgugaucccgaacaucggcucccggccccgcguccgggacauccccagccgcaucuccaucuacuggaccaucgugaagcccggggacauccugcucaucaacucgaccggcaaccugaucgccccgcggggguacuucaagauccgcuccggcaagagcuccaucaugcggucggacgcccccaucggcaagugcaacuccgagugcaucacgcccaacgggucgauccccaacgacaagccguuccagaacgugaaccgcaucaccuacggcgccugcccccgguacgucaagcaggacacccugaagcucgcgaccgggaugcgcaacgugcccgagaagcagacgcggggcaucuucggggccaucgccggcuucaucgagaacggcugggaggggaugguggacggcugguacggguuccgccaccagaacuccgagggcaucgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgcgugcaucggcucgauccgcaacgggaccuacgaccacgacgucuaccgggacgaggcccucaacaaccgcuuccagaucaagggcguggagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 3258 - RNA, 1701 nt, Artificial Sequence
  derived and/or modified CDS sequence (AUadapt) from InfluenzaA__ACT21509__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccucgaccgggggcaucugcgacagcccccaccagauccucgacggggagaacugcacccugaucgacgcccugcucggcgacccccagugcgacggcuuccagaacaagaagugggaccuguucguggagcgcuccaaggccuacuccaacugcuaccccuacgacgugccggacuacgcgucgcugcggucccucgucgccucguccgggacgcuggaguucaacaacgagagcuucaacuggaccggcgugacccagaacgggaccuccucggccugcaagcgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucucgcuguacgcgcaggccuccggccggaucaccgugagcacgaagcgcucgcagcagaccgugaucccgaacaucggcucccggccccgcguccgggacauccccucgcgcaucuccaucuacuggaccaucgugaagcccggggacauccugcucaucaacagcaccggcaaccugaucgccccgcggggguacuucaagauccgcuccggcaagucguccaucaugcggucggacgcccccaucggcaagugcaacuccgagugcaucacgcccaacgggucgauccccaacgacaagccguuccagaacgugaaccgcaucaccuacggcgccugcccccgguacgucaagcagaacacccugaagcucgcgaccgggaugcgcaacgugcccgagacgcagacccggggcaucuucggggccaucgccggcuucaucgagaacggcugggaggggaugguggacggcugguacggguuccgccaccagaacuccgagggcaccgggcaggccgccgaccucaagagcacccaggcggccaucaaccagaucaacggcaagcccaaccggcugaucggcaagacgaacgagaaguuccaccagaucgagaaggaguucuccgaggucgaggggcgcauccaggaccucgagaaguacguggaggacaccaagaucgaccuguggucguacaacgccgagcugcucguggcccuggagaaccagcacaccaucgaccugaccgacuccgagaugaacaagcuguucgagaagacgaagaagcagcugcgggagaacgccgaggacaugggcaacgggugcuucaagaucuaccacaagugcgacaacgcgugcaucggcucgauccgcaacgagaccuacgaccacgacgucuaccgcgacgaggcccugaacaaccgguuccagaucaaggggguggagcucaaguccggcuacaaggacuggauccuguggaucagcuucgccaucuccugcuuccugcucugcguggcccugcugggcuucaucaugugggccugccagaaggggaacauccgcugcaacaucugcaucuga

SEQ ID NO: 3259 - RNA, 1701 nt, Artificial Sequence
  derived and/or modified CDS sequence (AUadapt) from InfluenzaA__ACT21510__HA
augaagaccaucaucgcccugucguacauccucugccccguguucgcccagaagcugccgggcaacgacaacuccaccgcgacgcugugccucgggcaccacgccguccccaacggcaccaucgugaagaccaucaccaacgaccagaucgaggugacgaacgccaccgagcugguccagucguccucgaccgggggcaucugcgacagcccccaccagauccuggacggggagaacugcacccucaucgacgcccugcugggcgacccccagugcgacggcuuccagaacaagaagugggaccucuucguggagcgcuccaaggccuacuccaacugcuacccguacgacgugcccgacuacgcgucgcugcggucccuggucgccucguccgggacgcucgaguucaacaacgagagcuucaacuggaccggcgugacccagaacgggaccuccucggccugcaagcgccgguccaacaacucguucuucucccgccugaacuggcugacgcaccucaaguucaaguaccccgcccugaacgugaccaugcccaacaacgagaaguucgacaagcuguacaucuggggcguccaccacccggggaccgacaacgaccagaucucgcucuacgcgcaggccuccggccggaucaccgugagcacgaagcgcucgcagcagaccgugauccccaacaucggcucccggccccgcguccgggacauccccucgcgcaucuccaucuacuggaccaucgugaagccgggggacauccugcugaucaacagcaccggcaaccucaucgcgccccggggguacuucaagauccgcuccggcaagucguccaucaugcggucggacgcccccaucggcaagugcaacuccgagugcaucacgcccaacgggucgaucccgaacgacaagcccuuccaggacgugaaccgcaucaccuacggcgccugcccccgguacgucaagcagaacacccugaagcuggccaccgggaugcgcaacgugcccgagaagcagacgcggggcaucuucggggccaucgccggcuucaucgagaacggcugggaggggaugguggacggcugguacggguuccgccaccagaacuccgagggcaucgggcaggccgccgaccucaagagcacccaggcggccaucaaccagaucaacggcaagcugaaccggcugaucggcaagaccaacgagaaguuccaccagaucgagaaggaguucuccgaggucgaggggcgcauccaggaccucgagaaguacguggaggacaccaagaucgaccuguggucguacaacgccgagcugcucguggcccuggagaaccagcacacgaucgaccugaccgacuccgagaugaacaagcuguucgagcggaccgagaagcagcuccgcgagaacgccgaggacaugggcaacgggugcuucaagaucuaccacaagugcgacaacgcgggcaucgggucgauccgcaacggcaccuacgaccacgacgucuaccgggacgaggcccugaacaaccgcuuccagaucaagggcguggagcucaaguccggguacaaggacuggauccuguggaucagcuucgccaucuccugcuuccugcucugcguggcccugcugggcuucaucaugugggccugccagaaggggaacauccggugcaacaucugcaucuga

SEQ ID NO: 3260 - RNA, 1701 nt, Artificial Sequence; identical to SEQ ID NO: 3158
  derived and/or modified CDS sequence (AUadapt) from InfluenzaA__ACT21572__HA

SEQ ID NO: 3261 - RNA, 1701 nt, Artificial Sequence; identical to SEQ ID NO: 116
  derived and/or modified CDS sequence (AUadapt) from InfluenzaA__ACT22031__HA

SEQ ID NO: 3262 - RNA, 1701 nt, Artificial Sequence; identical to SEQ ID NO: 116
  derived and/or modified CDS sequence (AUadapt) from InfluenzaA__ACT22032__HA

SEQ ID NO: 3263 - RNA, 1701 nt, Artificial Sequence; identical to SEQ ID NO: 116
  derived and/or modified CDS sequence (AUadapt) from InfluenzaA__ACT22033__HA

SEQ ID NO: 3264 - RNA, 1701 nt, Artificial Sequence; identical to SEQ ID NO: 116
  derived and/or modified CDS sequence (AUadapt) from InfluenzaA__ACT22034__HA

SEQ ID NO: 3265 - RNA, 1701 nt, Artificial Sequence; identical to SEQ ID NO: 92
  derived and/or modified CDS sequence (AUadapt) from InfluenzaA__ACT22035__HA

SEQ ID NO: 3266 - RNA, 1701 nt, Artificial Sequence
  derived and/or modified CDS sequence (AUadapt) from InfluenzaA__ACT22036__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucaucaagaaggggaacagcuaccccaagcuguccaagucguacaucaacgacaagggcaaggaggugcuggugcucugggggauccaccaccccagcaccuccgccgaccagcagucgcuguaccagaacgccgacgccuacgucuucgugggcuccagccgguacuccaagaaguucaagcccgagaucgccauccgcccgaaggugcgggaccaggagggccgcaugaacuacuacuggacgcuggucgagcccggggacaagaucaccuucgaggcgaccggcaaccucguggugccccgguacgccuucgccauggagcgcaacgccgggucgggcaucaucaucuccgacacccccguccacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgugccgucgauccagucccgggggcuguucggcgccaucgccggguucaucgagggcggcuggaccgggauggucgacggcugguacggguaccaccaccagaacgagcagggcagcggguacgccgccgaccucaaguccacgcagaacgcgaucgacgagaucaccaacaaggugaacucggugaucgagaagaugaacacccaguucaccgccgucggcaaggaguucaaccaccuggagaagcgcaucgagaaccugaacaagaagguggacgacggcuuccucgacaucuggacguacaacgccgagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuaccccaaguacucggaggaggccaagcugaaccgggaggagaucgacggcgugaagcucgaguccacccgcaucuaccagauccuggcgaucuacagcaccguggccucgucccugguccucguggugagccugggggccaucuccuucuggaugugcagcaacggcucccugcagugccggaucugcaucuga

SEQ ID NO: 3267 - RNA, 1701 nt, Artificial Sequence
  derived and/or modified CDS sequence (AUadapt) from InfluenzaA__ACT22037__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 3268 - RNA, 1701 nt, Artificial Sequence
  derived and/or modified CDS sequence (AUadapt) from InfluenzaA__ACT22038__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccaacgccgaccagcagucccuguaccagaacgccgacgccuacguguucgugggcagcucccgguacucgaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucacgaucgggaagugccccaaguacgucaagucgaccaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagucgacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 3269 - RNA, 1701 nt, Artificial Sequence
  derived and/or modified CDS sequence (AUadapt) from InfluenzaA__ACT22055__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcugcggaaguccuacaucaacgacaagggcaaggaggugcugguccucugggggauccaccaccccagcaccucggccgaccagcagucccuguaccagaacgccgacgccuacguguucgugggcacgucgcgcuacuccaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccgggagcggcaucaucaucuccgacacgcccgugcacgacugcaacacgaccugccagaccccgaagggcgccaucaacaccucgcugcccuuccagaacauccaccccaucaccaucgggaagugccccaaguacgugaaguccaccaagcugcgccucgcgaccggccugcggaacgucccgagcauccagucccgcgggcuguucggcgccaucgccggguucaucgagggcggcuggacggggaugguggacggcugguacggguaccaccaccagaacgagcagggcucgggguacgccgccgaccucaaguccacccagaacgcgaucgacgagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaacgugaagaaccucuacgagaagguccggucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgugaagcucgaguccacccggaucuaccagauccuggcgaucuacucgaccgucgccuccagccuggugcucguggucucgcugggggccaucuccuucuggaugugcagcaacggcucccugcagugccgcaucugcaucuga

SEQ ID NO: 3270 - RNA, 1701 nt, Artificial Sequence; identical to SEQ ID NO: 3227
  derived and/or modified CDS sequence (AUadapt) from InfluenzaA__ACT22504__HA

SEQ ID NO: 3271 - RNA, 1701 nt, Artificial Sequence; identical to SEQ ID NO: 3156
  derived and/or modified CDS sequence (AUadapt) from InfluenzaA__ACT33122__HA

SEQ ID NO: 3272 - RNA, 1701 nt, Artificial Sequence
  derived and/or modified CDS sequence (AUadapt) from InfluenzaA__ACT33123__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgacccgcaucuaccagauccuggcgaucuacuccaccgucgccagcucgcuggugcucguggucucccugggggccaucagcuucuggaugugcuccaacggcagccugcaguuccggaucugcaucuga

SEQ ID NO: 3273 - RNA, 1701 nt, Artificial Sequence; identical to SEQ ID NO: 116
  derived and/or modified CDS sequence (AUadapt) from InfluenzaA__ACT33125__HA

SEQ ID NO: 3274 - RNA, 1701 nt, Artificial Sequence
  derived and/or modified CDS sequence (AUadapt) from InfluenzaA__ACT36505__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugaucgagcccggggacaagaucaccuucgaggcgaccggcaaccucguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgagccugguccucguggugucccugggggccaucucguucuggaugugcuccaacggcagccugcagugccggaucugcaucuga

SEQ ID NO: 3275 - RNA, 1701 nt, Artificial Sequence
  derived and/or modified CDS sequence (AUadapt) from InfluenzaA__ACT36649__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcccggagcugguccuacaucguggagaccucguccagcgacaacggcacgugcuaccccggcgacuucaucgacuacgaggagcuccgcgagcagcugaacuccgugucguccuucgagcgguucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccuccaccagcgccgaccagcagucgcuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggucgggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgucgauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgucaagagccucuacgagaaggugcggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggcgaucuacuccaccgucgccucgagccuggugcucguggucucccugggggccaucucguucuggaugugcuccaacggcagccugcagugccgcaucugcaucuga

SEQ ID NO: 3276 - RNA, 1701 nt, Artificial Sequence; identical to SEQ ID NO: 116
  derived and/or modified CDS sequence (AUadapt) from InfluenzaA__ACT36650__HA

SEQ ID NO: 3277 - RNA, 1701 nt, Artificial Sequence; identical to SEQ ID NO: 116
  derived and/or modified CDS sequence (AUadapt) from InfluenzaA__ACT36652__HA

SEQ ID NO: 3278 - RNA, 1701 nt, Artificial Sequence; identical to SEQ ID NO: 53
  derived and/or modified CDS sequence (AUadapt) from InfluenzaA__ACT36653__HA

SEQ ID NO: 3279 - RNA, 1701 nt, Artificial Sequence
  derived and/or modified CDS sequence (AUadapt) from InfluenzaA__ACT36655__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccggcaacggcacgugcuaccccggggacuucaucgacuacgaggagcuccgggagcagcugagcuccgugucguccuucgagcgcuucgagaucuuccccaagaccagcuccuggcccaaccacgacucgaacaagggcgucaccgccgccugcccgcacgccggggcgaaguccuucuacaagaaccugaucuggcucgugaagaagggcaacagcuaccccaagcuguccaagucguacaucaacgacaaggggaaggaggugcugguccucuggggcauccaccaccccagcaccuccgccgaccagcagucgcuguaccagaacgccgacgccuacguguucgugggcuccagccgguacuccaagaaguucaagcccgagaucgccauccgcccgaagguccgggaccaggaggggcgcaugaacuacuacuggacgcugguggagcccggcgacaagaucaccuucgaggcgaccgggaaccucguggucccccgguacgccuucgccauggagcgcaacgccggcucgggcaucaucaucuccgacacccccgugcacgacugcaacacgaccugccagaccccgaagggggccaucaacaccagccugcccuuccagaacauccaccccaucacgaucggcaagugccccaaguacgugaaguccaccaagcugcggcucgcgaccgggcugcgcaacgucccgucgauccagucccggggccuguucggggccaucgccggcuucaucgagggcggguggaccggcaugguggacgggugguacggcuaccaccaccagaacgagcaggggagcggcuacgccgccgaccucaaguccacgcagaacgcgaucgacgagaucaccaacaaggugaacucggucaucgagaagaugaacacccaguucaccgccgugggcaaggaguucaaccaccuggagaagcgcaucgagaaccugaacaagaaggucgacgacggguuccucgacaucuggacguacaacgccgagcugcuggugcuccuggagaacgagcggacccuggacuaccacgacuccaacgugaagaaccucuacgagaagguccgcagccagcugaagaacaacgccaaggagaucggcaacgggugcuucgaguucuaccacaagugcgacaacacgugcauggaguccgugaagaacggcaccuacgacuaccccaaguacucggaggaggccaagcugaaccgggaggagaucgacggggugaagcucgaguccacccgcaucuaccagauccuggcgaucuacagcaccgucgccucgucccuggugcucguggucagccugggcgccaucuccuucuggaugugcagcaacggcucccugcagugccggaucugcaucuga

SEQ ID NO: 3280 - RNA, 1701 nt, Artificial Sequence; identical to SEQ ID NO: 62
  derived and/or modified CDS sequence (AUadapt) from InfluenzaA__ACT36658__HA

SEQ ID NO: 3281 - RNA, 1701 nt, Artificial Sequence; identical to SEQ ID NO: 2940
  derived and/or modified CDS sequence (AUadapt) from InfluenzaA__ACT36659__HA

SEQ ID NO: 3282 - RNA, 1701 nt, Artificial Sequence; identical to SEQ ID NO: 62
  derived and/or modified CDS sequence (AUadapt) from InfluenzaA__ACT36661__HA

SEQ ID NO: 3283 - RNA, 1701 nt, Artificial Sequence; identical to SEQ ID NO: 116
  derived and/or modified CDS sequence (AUadapt) from InfluenzaA__ACT36663__HA

SEQ ID NO: 3284 - RNA, 1701 nt, Artificial Sequence; identical to SEQ ID NO: 116
  derived and/or modified CDS sequence (AUadapt) from InfluenzaA__ACT36666__HA

SEQ ID NO: 3285 - RNA, 1701 nt, Artificial Sequence
  derived and/or modified CDS sequence (AUadapt) from InfluenzaA__ACT52687__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcuccucgcgguacuccaagaaguucaagcccgagaucgccauccgcccgaagguccggggccaggaggggcgcaugaacuacuacuggacgcugguggagcccggcgacaagaucaccuucgaggcgaccgggaaccucguggucccccgguacgccuucgccauggagcgcaacgccggcagcggcaucaucaucuccgacacccccgugcacgacugcaacacgaccugccagaccccgaagggggccaucaacaccucgcugcccuuccagaacauccaccccaucacgaucggcaagugccccaaguacgugaaguccaccaagcugcggcucgcgaccgggcugcgcaacgucccgagcauccagucccggggccuguucggggccaucgccggcuucaucgagggcggguggaccggcaugguggacgggugguacggcuaccaccaccagaacgagcaggggagcggcuacgccgccgaccucaaguccacgcagaacgcgaucgacgagaucaccaacaaggugaacucggucaucgagaagaugaacacccaguucaccgccgugggcaaggaguucaaccaccuggagaagcgcaucgagaaccugaacaagaaggucgacgacggguuccucgacaucuggacguacaacgccgagcugcuggugcuccuggagaacgagcggacccuggacuaccacgacuccaacgugaagaaccucuacgagaagguccgcagccagcugaagaacaacgccaaggagaucggcaacgggugcuucgaguucuaccacaagugcgacaacacgugcauggaguccgugaagaacggcaccuacgacuaccccaaguacucggaggaggccaagcugaaccgggaggagaucgacggggugaagcucgaguccacccgcuucuaccagauccuggcgaucuacagcaccgucgccucgucccuggugcucguggucagccugggcgccaucuccuucuggaugugcagcaacggcucccugcagugccggaucugcaucuga

SEQ ID NO: 3286 - RNA, 1701 nt, Artificial Sequence; identical to SEQ ID NO: 62
  derived and/or modified CDS sequence (AUadapt) from InfluenzaA__ACT54606__HA

SEQ ID NO: 3287 - RNA, 1701 nt, Artificial Sequence; identical to SEQ ID NO: 116
  derived and/or modified CDS sequence (AUadapt) from InfluenzaA__ACT66146__HA

SEQ ID NO: 3288 - RNA, 1701 nt, Artificial Sequence; identical to SEQ ID NO: 3156
  derived and/or modified CDS sequence (AUadapt) from InfluenzaA__ACT66155__HA

SEQ ID NO: 3289 - RNA, 1701 nt, Artificial Sequence
  derived and/or modified CDS sequence (AUadapt) from InfluenzaA__ACT66162__HA
auggaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcaccugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 3290 - RNA, 1701 nt, Artificial Sequence; identical to SEQ ID NO: 116
  derived and/or modified CDS sequence (AUadapt) from InfluenzaA__ACT67239__HA

SEQ ID NO: 3291 - RNA, 1701 nt, Artificial Sequence; identical to SEQ ID NO: 116
  derived and/or modified CDS sequence (AUadapt) from InfluenzaA__ACT67255__HA

SEQ ID NO: 3292 - RNA, 1701 nt, Artificial Sequence; identical to SEQ ID NO: 62
  derived and/or modified CDS sequence (AUadapt) from InfluenzaA__ACT68102__HA

SEQ ID NO: 3293 - RNA, 1701 nt, Artificial Sequence
  derived and/or modified CDS sequence (AUadapt) from InfluenzaA__ACT68103__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcuccucgcgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagacccugaagggcgccaucaacaccucgcugccguuccagaacauccaccccaucacgaucgggaagugccccaaguacgugaaguccaccaagcuccggcuggcgaccggccugcgcaacguccccagcauccagucccggggccucuucggggccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacucggucaucgagaagaugaacacccaguucaccgccgugggcaaggaguucaaccaccuggagaagcgcaucgagaaccucaacaagaaggucgacgacggcuuccuggacaucuggacguacaacgccgagcugcucgugcugcuggagaacgagcggacccucgacuaccacgacuccaacgugaagaaccuguacgagaagguccgcagccagcugaagaacaacgccaaggagaucgggaacggcugcuucgaguucuaccacaagugcgacaacacgugcauggaguccgugaagaacgggaccuacgacuacccgaaguacucggaggaggccaagcucaaccgggaggagaucgacggcgugaagcuggaguccacccgcaucuaccagauccuggcgaucuacagcaccgucgccucgucccucgugcugguggucagccugggggccaucuccuucuggaugugcagcaacggcucccuccagugccggaucugcaucuga

SEQ ID NO: 3294 - RNA, 1701 nt, Artificial Sequence; identical to SEQ ID NO: 62
  derived and/or modified CDS sequence (AUadapt) from InfluenzaA__ACT68104__HA

SEQ ID NO: 3295 - RNA, 1701 nt, Artificial Sequence
  derived and/or modified CDS sequence (AUadapt) from InfluenzaA__ACT68105__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagcaaguacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggucgggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgucgauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuaccccaaguacucgggcgaggccaagcugaaccgcgaggagaucgacggggugaagcucgaguccacccggaucuaccagauccuggcgaucuacagcaccgucgccucgucccuggugcucguggucagccugggcgccaucuccuucuggaugugcagcaacggcucccugcagugccgcaucugcaucuga

SEQ ID NO: 3296 - RNA, 1701 nt, Artificial Sequence; identical to SEQ ID NO: 62
  derived and/or modified CDS sequence (AUadapt) from InfluenzaA__ACT68106__HA

SEQ ID NO: 3297 - RNA, 1701 nt, Artificial Sequence; identical to SEQ ID NO: 62
  derived and/or modified CDS sequence (AUadapt) from InfluenzaA__ACT68107__HA

SEQ ID NO: 3298 - RNA, 1701 nt, Artificial Sequence; identical to SEQ ID NO: 96
  derived and/or modified CDS sequence (AUadapt) from InfluenzaA__ACT68108__HA

SEQ ID NO: 3299 - RNA, 1701 nt, Artificial Sequence
  derived and/or modified CDS sequence (AUadapt) from InfluenzaA__ACT68109__HA
augaaggccauccuggugguccuccuguacaccuucgccaccgcgaacacggacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagacguccagcuccgacaacgggaccugcuaccccggcgacuucaucgacuacgaggagcuccgggagcagcugucguccgugagcuccuucgagcgcuucgagaucuuccccaagaccucguccuggcccaaccacgacagcaacaagggcgucaccgccgccugcccgcacgccggcgccaaguccuucuacaagaaccugaucuggcucgugaagaaggggaacucguaccccaagcuguccaagagcuacaucaacgacaagggcaaggaggugcugguccucugggggauccaccaccccucgacguccgcggaccagcagagccuguaccagaacgccgacgccuacguguucgugggcaccucccgguacucgaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggccaucuacuccaccgucgcgucgagccuggugcucguggucucccugggggccaucucguucuggaugugcuccaacggcagccugcagugccggaucugcaucuga

SEQ ID NO: 3300 - RNA, 1701 nt, Artificial Sequence; identical to SEQ ID NO: 62
  derived and/or modified CDS sequence (AUadapt) from InfluenzaA__ACT68110__HA

SEQ ID NO: 3301 - RNA, 1701 nt, Artificial Sequence; identical to SEQ ID NO: 62
  derived and/or modified CDS sequence (AUadapt) from InfluenzaA__ACT68112__HA

SEQ ID NO: 3302 - RNA, 1701 nt, Artificial Sequence; identical to SEQ ID NO: 62
  derived and/or modified CDS sequence (AUadapt) from InfluenzaA__ACT68113__HA

SEQ ID NO: 3303 - RNA, 1701 nt, Artificial Sequence; identical to SEQ ID NO: 62
  derived and/or modified CDS sequence (AUadapt) from InfluenzaA__ACT68115__HA

SEQ ID NO: 3304 - RNA, 1701 nt, Artificial Sequence; identical to SEQ ID NO: 62
  derived and/or modified CDS sequence (AUadapt) from InfluenzaA__ACT68119__HA

SEQ ID NO: 3305 - RNA, 1701 nt, Artificial Sequence
  derived and/or modified CDS sequence (AUadapt) from InfluenzaA__ACT79133__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggaagcugguggagcccggggacaagaucaccuucgaggcgaccggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucacgaucgggaagugccccaaguacgucaagucgaccaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagucgacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 3306 - RNA, 1701 nt, Artificial Sequence; identical to SEQ ID NO: 62
  derived and/or modified CDS sequence (AUadapt) from InfluenzaA__ACT79143__HA

SEQ ID NO: 3307 - RNA, 1701 nt, Artificial Sequence; identical to SEQ ID NO: 2940
  derived and/or modified CDS sequence (AUadapt) from InfluenzaA__ACT79153__HA

SEQ ID NO: 3308 - RNA, 1701 nt, Artificial Sequence; identical to SEQ ID NO: 3227
  derived and/or modified CDS sequence (AUadapt) from InfluenzaA__ACT79163__HA

SEQ ID NO: 3309 - RNA, 1701 nt, Artificial Sequence; identical to SEQ ID NO: 3227
  derived and/or modified CDS sequence (AUadapt) from InfluenzaA__ACT79173__HA

SEQ ID NO: 3310 - RNA, 1701 nt, Artificial Sequence
  derived and/or modified CDS sequence (AUadapt) from InfluenzaA__ACT79625__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccaccgccugcccgcacgccggcgccaaguccuucuacaagaaccugaucuggcucgugaagaaggggaacucguaccccaagcuguccaagagcuacaucaacgacaagggcaaggaggugcugguccucugggggauccaccaccccucgacguccgcggaccagcagagccuguaccagaacgccgacgccuacguguucgugggcaccucccgguacucgaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacgagaucaccaacaaggugaacuccgucaucgagaagaugaacacgcaguucaccgcggugggcaaggaguucaaccaccuggagaagcgcaucgagaaccugaacaagaagaucgacgacggcuuccucgacaucuggaccuacaacgccgagcugcugguccuccugaagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggccaucuacuccaccguggcgucgagccugguccucguggugucccugggggccaucucguucuggaugugcuccaacggcagccugcagugccggaucugcaucuga

SEQ ID NO: 3311 - RNA, 1701 nt, Artificial Sequence; identical to SEQ ID NO: 62
  derived and/or modified CDS sequence (AUadapt) from InfluenzaA__ACT79627__HA

SEQ ID NO: 3312 - RNA, 1701 nt, Artificial Sequence
  derived and/or modified CDS sequence (AUadapt) from InfluenzaA__ACT82512__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgagaagguccgcucccaguucaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcuggagucgacccgcaucuaccagauccucgcgaucuacuccaccgucgccagcucgcuggugcugguggucucccucggggccaucagcuucuggaugugcuccaacggcagccugcagugccggaucugcaucuga

SEQ ID NO: 3313 - RNA, 1701 nt, Artificial Sequence; identical to SEQ ID NO: 116
  derived and/or modified CDS sequence (AUadapt) from InfluenzaA__ACT82513__HA

SEQ ID NO: 3314 - RNA, 1701 nt, Artificial Sequence
  derived and/or modified CDS sequence (AUadapt) from InfluenzaA__ACT82514__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucgaacacgcccgugcacgacugcaacacgaccugccagaccccgaagggcuccaucaacaccagccugcccuuccagaacauccaccccaucaccaucgggaagugccccaaguacgugaaguccaccaagcugcggcucgccaccggccugcgcaacgucccgucgauccagucccgggggcuguucggcgcgaucgccggguucaucgagggcggcuggacggggaugguggacggcugguacggguaccaccaccagaacgagcagggcagcggguacgccgccgaccucaaguccacccagaacgccaucgacgagaucaccaacaaggugaacucggucaucgagaagaugaacacccaguucacggcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggccaucuacagcaccgucgcgucgucccuggugcucguggucagccugggggccaucuccuucuggaugugcagcaacggcucccugcagugccggaucugcaucuga

SEQ ID NO: 3315 - RNA, 1701 nt, Artificial Sequence; identical to SEQ ID NO: 116
  derived and/or modified CDS sequence (AUadapt) from InfluenzaA__ACT82515__HA

SEQ ID NO: 3316 - RNA, 1701 nt, Artificial Sequence
  derived and/or modified CDS sequence (AUadapt) from InfluenzaA__ACT82516__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucauggugccccgguacgccuucgccauggagcgcaacgccgggucgggcaucaucaucuccgacacccccguccacgacugcaacacgaccugccagaccccgaagggcgccaucaacaccagccugcccuuccacaacauccaccccaucacgaucgggaagugccccaaguacgugaaguccaccaagcugcggcucgcgaccggccugcgcaacgugccgucgauccagucccgggggcuguucggcgccaucgccggguucaucgagggcggcuggaccgggauggucgacggcugguacggguaccaccaccagaacgagcagggcagcggguacgccgccgaccucaaguccacgcagaacgcgaucgacgagaucaccaacaaggugaacucggugaucgagaagaugaacacccaguucaccgccgucggcaaggaguucaaccaccuggagaagcgcaucgagaaccugaacaagaagguggacgacggcuuccucgacaucuggacguacaacgccgagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuaccccaaguacucggaggaggccaagcugaaccgggaggagaucgacggcgugaagcucgaguccacccgcaucuaccagauccuggcgaucuacagcaccguggccucgucccugguccucguggugagccugggggccaucuccuucuggaugugcagcaacggcucccugcagugccggaucugcaucuga

SEQ ID NO: 3317 - RNA, 1701 nt, Artificial Sequence; identical to SEQ ID NO: 3156
  derived and/or modified CDS sequence (AUadapt) from InfluenzaA__ACT83795__HA

SEQ ID NO: 3318 - RNA, 1701 nt, Artificial Sequence; identical to SEQ ID NO: 3156
  derived and/or modified CDS sequence (AUadapt) from InfluenzaA__ACT83805__HA

SEQ ID NO: 3319 - RNA, 1701 nt, Artificial Sequence; identical to SEQ ID NO: 116
  derived and/or modified CDS sequence (AUadapt) from InfluenzaA__ACT83815__HA

SEQ ID NO: 3320 - RNA, 1701 nt, Artificial Sequence; identical to SEQ ID NO: 116
  derived and/or modified CDS sequence (AUadapt) from InfluenzaA__ACT83825__HA

SEQ ID NO: 3321 - RNA, 1701 nt, Artificial Sequence; identical to SEQ ID NO: 116
  derived and/or modified CDS sequence (AUadapt) from InfluenzaA__ACT83835__HA

SEQ ID NO: 3322 - RNA, 1701 nt, Artificial Sequence; identical to SEQ ID NO: 3007
  derived and/or modified CDS sequence (AUadapt) from InfluenzaA__ACT83845__HA

SEQ ID NO: 3323 - RNA, 1701 nt, Artificial Sequence; identical to SEQ ID NO: 62
  derived and/or modified CDS sequence (AUadapt) from InfluenzaA__ACT83855__HA

SEQ ID NO: 3324 - RNA, 1701 nt, Artificial Sequence; identical to SEQ ID NO: 116
  derived and/or modified CDS sequence (AUadapt) from InfluenzaA__ACT83865__HA

SEQ ID NO: 3325 - RNA, 1701 nt, Artificial Sequence; identical to SEQ ID NO: 3156
  derived and/or modified CDS sequence (AUadapt) from InfluenzaA__ACT83875__HA

SEQ ID NO: 3326 - RNA, 1701 nt, Artificial Sequence; identical to SEQ ID NO: 3156
  derived and/or modified CDS sequence (AUadapt) from InfluenzaA__ACT85999__HA

SEQ ID NO: 3327 - RNA, 1701 nt, Artificial Sequence; identical to SEQ ID NO: 3156
  derived and/or modified CDS sequence (AUadapt) from InfluenzaA__ACT86009__HA

SEQ ID NO: 3328 - RNA, 1701 nt, Artificial Sequence; identical to SEQ ID NO: 116
  derived and/or modified CDS sequence (AUadapt) from InfluenzaA__ACT86019__HA

SEQ ID NO: 3329 - RNA, 1701 nt, Artificial Sequence; identical to SEQ ID NO: 3007
  derived and/or modified CDS sequence (AUadapt) from InfluenzaA__ACT86029__HA

SEQ ID NO: 3330 - RNA, 1701 nt, Artificial Sequence; identical to SEQ ID NO: 116
  derived and/or modified CDS sequence (AUadapt) from InfluenzaA__ACT86039__HA

SEQ ID NO: 3331 - RNA, 1701 nt, Artificial Sequence; identical to SEQ ID NO: 116
  derived and/or modified CDS sequence (AUadapt) from InfluenzaA__ACT86059__HA

SEQ ID NO: 3332 - RNA, 1701 nt, Artificial Sequence; identical to SEQ ID NO: 116
  derived and/or modified CDS sequence (AUadapt) from InfluenzaA__ACT86069__HA

SEQ ID NO: 3333 - RNA, 1701 nt, Artificial Sequence; identical to SEQ ID NO: 116
  derived and/or modified CDS sequence (AUadapt) from InfluenzaA__ACT86079__HA

SEQ ID NO: 3334 - RNA, 1701 nt, Artificial Sequence; identical to SEQ ID NO: 116
  derived and/or modified CDS sequence (AUadapt) from InfluenzaA__ACT86089__HA

SEQ ID NO: 3335 - RNA, 1701 nt, Artificial Sequence; identical to SEQ ID NO: 116
  derived and/or modified CDS sequence (AUadapt) from InfluenzaA__ACT86099__HA

SEQ ID NO: 3336 - RNA, 1701 nt, Artificial Sequence; identical to SEQ ID NO: 3156
  derived and/or modified CDS sequence (AUadapt) from InfluenzaA__ACT86109__HA

SEQ ID NO: 3337 - RNA, 1701 nt, Artificial Sequence; identical to SEQ ID NO: 116
  derived and/or modified CDS sequence (AUadapt) from InfluenzaA__ACT86119__HA

SEQ ID NO: 3338 - RNA, 1701 nt, Artificial Sequence; identical to SEQ ID NO: 3156
  derived and/or modified CDS sequence (AUadapt) from InfluenzaA__ACT86129__HA

SEQ ID NO: 3339 - RNA, 1701 nt, Artificial Sequence; identical to SEQ ID NO: 116
  derived and/or modified CDS sequence (AUadapt) from InfluenzaA__ACT86139__HA

SEQ ID NO: 3340 - RNA, 1701 nt, Artificial Sequence
  derived and/or modified CDS sequence (AUadapt) from InfluenzaA__ACU00932__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaacuucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 3341 - RNA, 1701 nt, Artificial Sequence; identical to SEQ ID NO: 116
  derived and/or modified CDS sequence (AUadapt) from InfluenzaA__ACU00942__HA

SEQ ID NO: 3342 - RNA, 1701 nt, Artificial Sequence; identical to SEQ ID NO: 116
  derived and/or modified CDS sequence (AUadapt) from InfluenzaA__ACU00952__HA

SEQ ID NO: 3343 - RNA, 1701 nt, Artificial Sequence
  derived and/or modified CDS sequence (AUadapt) from InfluenzaA__ACU12494__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcucgaaggccuacuccaacugcuaccccuacgacgugccggacuacgcgagccuccggucccuggucgccucguccggcacgcuggaguucaucaacgaggacuucaacuggaccgggguggcccagagcggcgaguccuacgccugcaagcgcgggucggugaaguccuucuucagccggcucaacuggcugcacgaguccgacuacaaguaccccgcgcugaacgucaccaugcccaacaacggcaaguucgacaagcucuacaucuggggcgugcaccaccccaucaccgaccgcgagcagacgagccuguacgugcgggccuccgggcgcgucaccgugucgaccaagcggagccagcagaccgugaucccgaacaucggcucccgccccuggguccgggggcugucgucccgcaucagcaucuacuggacgaucgugaagcccggcgacauccuccugaucaacuccaccgggaaccugaucgcgccccggggcuacuucaagauccgcaccggcaagucguccaucaugcggagcgacgccccgaucgggaccugcuccucggagugcaucacgcccaacggcuccauccccaacgacaagcccuuccagaacgugaaccgcaucaccuacggggccugcccgcgguacgucaagcagaacacccucaagcuggccaccggcaugcgcaacgugcccgagaagcagacgcgggggaucuucggcgccaucgccggcuucaucgagaacgggugggagggcaugguggacgggugguacggcuuccgccaccagaacagcgaggggaccggccaggccgccgaccugaaguccacccaggcggccaucgaccagaucaacggcaagcucaaccggcugaucgagaagaccaacgagaaguuccaccagaucgagaaggaguucucggaggucgaggggcgcauccaggaccuggagaaguacguggaggacacgaagaucgaccucugguccuacaacgccgagcugcugguggcccucgagaaccagcacaccaucgaccugaccgacagcgagaugaacaagcuguucgagaagacccgcaagcagcuccgggagaacgccgaggacaugggcaacgggugcuucaagaucuaccacaagugcgacaacgcgugcaucggcuccauccgcaacgggacguacgaccacgacgucuaccgggacgaggcccugaacaaccgcuuccagaucaagggcguggagcugaaguccggcuacaaggacuggauccucuggaucuccuucgccaucagcugcuuccugcugugcgucgugcuccugggguucaucaugugggccugccagaagggcaacauccggugcaacaucugcaucuga

SEQ ID NO: 3344 - RNA, 1698 nt, Artificial Sequence; identical to SEQ ID NO: 3026
  derived and/or modified CDS sequence (AUadapt) from InfluenzaA__ACU12505__HA

SEQ ID NO: 3345 - RNA, 1701 nt, Artificial Sequence
  derived and/or modified CDS sequence (AUadapt) from InfluenzaA__ACU12516__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugguggacgcccugcucggcgacccccagugcgacggcuuccagaacaagaagugggaccuguucguggagcgcucgaaggccuacuccaacugcuaccccuacgacgucccggacuacgcgagccugcggucccucguggccucguccgggacgcuggaguucaacaacgagucguucaacuggaccggcgugacccagaacgggaccuccagcgccugcaagcgccgguccaacaacucguucuucucccgccugaacuggcucacgcaccugaaguucaaguaccccgcccugaacgucaccaugcccaacaacgagaaguucgacaagcucuacaucuggggcgugcaccaccccgggaccgacaacgaccagaucagccuguacgcgcaggccuccggccggaucaccgugucgacgaagcgcucgcagcagaccgucaucccgaacaucggcucccggccccgcgugcgggacaucagcucccgcaucucgaucuacuggaccaucgugaagcccggggacauccugcucaucaacuccaccggcaaccugaucgcgccccggggguacuucaagauccgcucgggcaaguccagcaucaugcgguccgacgccccgaucggcaagugcaacucggagugcaucacgcccaacggguccauccccaacgacaagcccuuccagaacgucaaccgcaucaccuacggcgccugcccgcgguacgugaagcagaacacccugaagcucgccaccgggaugcgcaacgugcccgagacgcagacccggggcaucuucggggccaucgccggcuucaucgagaacggcugggaggggauggucgacggcugguacggguuccgccaccagaacucggagggcaccgggcaggccgccgaccugaaguccacccaggcggccaucaaccagaucaacggcaagcugaaccggcucaucggcaagacgaacgagaaguuccaccagaucgagaaggaguucagcgagguggaggggcgcauccaggaccuggagaaguacguggaggacaccaagaucgaccugugguccuacaacgccgagcuccuggucgcccuggagaaccagcacaccaucgaccucaccgacucggagaugaacaagcuguucgagcggacgaagaagcagcugcgcgagaacgccgaggacaugggcaacgggugcuucaagaucuaccacaagugcgacaacgcgugcaucggcuccauccgcaacgggaccuacgaccacgacguguaccgggacgaggcccucaacaaccgcuuccagaucaagggcguggagcugaaguccggcuacaaggacuggauccuguggaucuccuucgccaucagcugcuuccuccugugcgucgcccugcucggguucaucaugugggccugccagaagggcaacauccggugcaacaucugcaucuga

SEQ ID NO: 3346 - RNA, 1701 nt, Artificial Sequence; identical to SEQ ID NO: 875
  derived and/or modified CDS sequence (AUadapt) from InfluenzaA__ACU12527__HA

SEQ ID NO: 3347 - RNA, 1701 nt, Artificial Sequence; identical to SEQ ID NO: 2617
  derived and/or modified CDS sequence (AUadapt) from InfluenzaA__ACU12538__HA

SEQ ID NO: 3348 - RNA, 1701 nt, Artificial Sequence; identical to SEQ ID NO: 1813
  derived and/or modified CDS sequence (AUadapt) from InfluenzaA__ACU12549__HA

SEQ ID NO: 3349 - RNA, 1698 nt, Artificial Sequence
  derived and/or modified CDS sequence (AUadapt) from InfluenzaA__ACU12560__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccucgguguccagcuucgagcgguucgagaucuucccgaaggaguccagcuggcccaaccacacggucaccgggguguccgccagcugcucccacaacggcgagucguccuucuaccgcaaccugcuguggcucaccgggaagaacggccuguaccccaaccugagcaaguccuacgccaacaacaaggggaaggaggugcucguccuguggggcgugcaccacccgcccaacaucggcgaccagaacacccuguaccacacggagaacgccuacgugagcgucgugagcucccacuacucgcggaaguucacccccgagaucgccaagcgccccaaggugcgggaccaggaggggcgcaucaacuacuacuggacccuccuggagcccggcgacaccaucaucuucgaggccaacgggaaccugaucgcgccgcgguacgccuucgcccucucccgcggcuucggcagcgggaucaucaacuccaacguccccauggacaagugcgacgccaagugccagacgccccagggcgccaucaacagcucccugcccuuccagaacgugcacccggugaccaucggggagugccccaaguacguccggagcgcgaagcugcgcauggugaccggccuccggaacauccccuccauccagucgcgcgggcuguucggcgccaucgccggcuucaucgagggcggcuggaccgggaugguggacggcugguacggguaccaccaccagaacgagcagggcuccggcuacgccgccgaccagaaguccacgcagaacgcgaucaacgggaucaccaacaaggucaacagcgugaucgagaagaugaacacccaguucaccgccgucggcaaggaguucaacaagcuggagcggcgcauggagaaccucaacaagaagguggacgacggguucaucgacaucuggacguacaacgccgagcugcuggugcuccuggagaacgagcggacccuggacuuccacgacagcaacgucaagaaccucuacgagaaggugaagucccagcugaagaacaacgccaaggagaucggcaacgggugcuucgaguucuaccacaagugcaacgacgagugcauggagagcgugaagaacggcaccuacgacuaccccaaguacuccgaggagucgaagcugaaccgcgagaagaucgacggcgucaagcucgaguccauggggguguaccagauccuggccaucuacagcaccguggcgagcucccugguccuccuggugagccugggcgccaucuccuucuggaugugcagcaacgggucccuccagugccggaucugcaucuga

SEQ ID NO: 3350 - RNA, 1698 nt, Artificial Sequence; identical to SEQ ID NO: 2733
  derived and/or modified CDS sequence (AUadapt) from InfluenzaA__ACU12571__HA

SEQ ID NO: 3351 - RNA, 1698 nt, Artificial Sequence
  derived and/or modified CDS sequence (AUadapt) from InfluenzaA__ACU12582__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccgcuucgccgacuacgaggagcugcgggagcagcucuccagcguguccagcuucgagcgcuucgagaucuucccgaaggaguccagcuggcccaaccacacggucaccgggguguccgccucgugcucccacaacggcgagagcuccuucuaccggaaccugcuguggcucaccgggaagaacggccuguaccccaaccugagcaaguccuacgccaacaacaaggggaaggaggugcucguccuguggggcgugcaccacccgcccaacaucggcgaccagaacacccuguaccacacggagaacgccuacgugucggucgugagcucccacuacagccgcaaguucacccccgagaucgccaagcggcccaaggugcgcgaccaggaggggcggaucaacuacuacuggacccuccuggagcccggcgacaccaucaucuucgaggccaacgggaaccugaucgcgccgcgcuacgccuucgcccucucccggggcuucggcagcgggaucaucaacuccaacgcccccauggacaagugcgacgccaagugccagacgccccagggcgcgaucaacucgucccugcccuuccagaacguccacccggugaccaucggggagugccccaaguacgugcgcagcgccaagcugcggauggucaccggccuccgcaacauccccuccauccagagccgggggcuguucggcgccaucgccggcuucaucgagggcggcuggaccgggaugguggacggcugguacggguaccaccaccagaacgagcagggcuccggcuacgccgcggaccagaaguccacgcagaacgccaucaacgggaucaccaacaaggugaacucggucaucgagaagaugaacacccaguucaccgccgugggcaaggaguucaacaagcuggagcgccggauggagaaccucaacaagaaggucgacgacggguucaucgacaucuggacguacaacgccgagcugcuggugcuccuggagaacgagcgcacccuggacuuccacgacagcaacgugaagaaccucuacgagaaggucaagucccagcugaagaacaacgccaaggagaucggcaacgggugcuucgaguucuaccacaagugcaacgacgagugcauggagagcgugaagaacggcaccuacgacuaccccaaguacuccgaggagagcaagcugaaccgggagaagaucgacggcgugaagcucgaguccaugggggucuaccagauccuggcgaucuacucgaccguggccagcucccuggugcuccuggucagccugggcgccaucuccuucuggaugugcagcaacgggucccuccagugccgcaucugcaucuga

SEQ ID NO: 3352 - RNA, 1698 nt, Artificial Sequence
  derived and/or modified CDS sequence (AUadapt) from InfluenzaA__ACU12593__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccucgguguccagcuucgagcgguucgagaucuucccgaaggaguccagcuggcccaaccacacggucaccgggguguccgccagcugcucccacaacggcgagucguccuucuaccgcaaccugcuguggcucaccgggaagaacggccuguaccccaaccugagcaaguccuacgccaacaacaaggagaaggaggugcucguccuguggggcgugcaccacccgcccaacaucguggaccagaagacccuguaccggacggagaacgccuacgucagcguggugagcucccacuacucgcgcaaguucacccccgagaucgccaagcggcccaagguccgcgaccaggagggccggaucaacuacuacuggacccuccuggagcccggcgacaccaucaucuucgaggccaacgggaaccugaucgcgccgcgcuacgccuucgcccucucccggggcuucgggagcggcaucaucaacuccaacgcccccauggacaagugcgacgccaagugccagacgccccagggcgcgaucaacagcucccugcccuuccagaacgugcacccggugaccaucggggagugccccaaguacguccgcagcgccaagcugcggauggugaccggccuccgcaacauccccuccauccagucgcgggggcuguucggcgccaucgccggguucaucgagggcggcuggaccgggaugguggacggcugguacggguaccaccaccagaacgagcagggcuccggguacgccgcggaccagaaguccacgcagaacgccaucgacggcaucaccaacaaggucaacagcgugaucgagaagaugaacacccaguucaccgccgucggcaaggaguucaacaagcuggagcgccggauggagaaccucaacaagaagguggacgacggguucaucgacaucuggacguacaacgccgagcugcuggugcuccuggagaacgagcgcacccuggacuuccacgacagcaacgucaagaaccucuacgagaaggugaagucccagcugaagaacaacgccaaggagaucggcaacgggugcuucgaguucuaccacaagugcaacgacgagugcauggagagcgugaagaacggcaccuacgacuaccccaaguacuccgaggagucgaagcugaaccgggagaagaucgacgggaucaagcucgaguccaugggcgucuaccagauccuggcgaucuacagcaccguggccagcucccuggugcuccuggucagccugggcgccaucuccuucuggaugugcagcaacgggucccuccagugccgcaucugcaucuga

SEQ ID NO: 3353 - RNA, 1701 nt, Artificial Sequence; identical to SEQ ID NO: 116
  derived and/or modified CDS sequence (AUadapt) from InfluenzaA__ACU13090__HA

SEQ ID NO: 3354 - RNA, 1701 nt, Artificial Sequence; identical to SEQ ID NO: 116
  derived and/or modified CDS sequence (AUadapt) from InfluenzaA__ACU13091__HA

SEQ ID NO: 3355 - RNA, 1701 nt, Artificial Sequence; identical to SEQ ID NO: 116
  derived and/or modified CDS sequence (AUadapt) from InfluenzaA__ACU13092__HA

SEQ ID NO: 3356 - RNA, 1701 nt, Artificial Sequence; identical to SEQ ID NO: 116
  derived and/or modified CDS sequence (AUadapt) from InfluenzaA__ACU13093__HA

SEQ ID NO: 3357 - RNA, 1701 nt, Artificial Sequence; identical to SEQ ID NO: 117
  derived and/or modified CDS sequence (AUadapt) from InfluenzaA__ACU13094__HA

SEQ ID NO: 3358 - RNA, 1701 nt, Artificial Sequence; identical to SEQ ID NO: 116
  derived and/or modified CDS sequence (AUadapt) from InfluenzaA__ACU13095__HA

SEQ ID NO: 3359 - RNA, 1701 nt, Artificial Sequence
  derived and/or modified CDS sequence (AUadapt) from InfluenzaA__ACU13096__HA
augaaggccauccuggugguccuccugcacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcuccucgcgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccucgcugcccuuccagaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcucgggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugacccucgaguccacccgcaucuaccagauccuggcgaucuacucgaccgucgccagcucccuggugcucguggucucgcugggggccaucuccuucuggaugugcagcaacggcucccugcagugccggaucugcaucuga

SEQ ID NO: 3360 - RNA, 1701 nt, Artificial Sequence; identical to SEQ ID NO: 116
  derived and/or modified CDS sequence (AUadapt) from InfluenzaA__ACU13098__HA

SEQ ID NO: 3361 - RNA, 1701 nt, Artificial Sequence
  derived and/or modified CDS sequence (AUadapt) from InfluenzaA__ACU13099__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccacagcaucaccaucgggaagugccccaaguacgugaaguccaccaagcugcggcucgcgaccggccugcgcaacguccccucgauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacucggucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuacccgaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 3362 - RNA, 1701 nt, Artificial Sequence
  derived and/or modified CDS sequence (AUadapt) from InfluenzaA__ACU13129__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcgaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 3363 - RNA, 1701 nt, Artificial Sequence; identical to SEQ ID NO: 116
  derived and/or modified CDS sequence (AUadapt) from InfluenzaA__ACU16795__HA

SEQ ID NO: 3364 - RNA, 1701 nt, Artificial Sequence; identical to SEQ ID NO: 116
  derived and/or modified CDS sequence (AUadapt) from InfluenzaA__ACU16858__HA

SEQ ID NO: 3365 - RNA, 1701 nt, Artificial Sequence; identical to SEQ ID NO: 116
  derived and/or modified CDS sequence (AUadapt) from InfluenzaA__ACU16930__HA

SEQ ID NO: 3366 - RNA, 1701 nt, Artificial Sequence; identical to SEQ ID NO: 116
  derived and/or modified CDS sequence (AUadapt) from InfluenzaA__ACU16993__HA

SEQ ID NO: 3367 - RNA, 1701 nt, Artificial Sequence; identical to SEQ ID NO: 116
  derived and/or modified CDS sequence (AUadapt) from InfluenzaA__ACU17059__HA

SEQ ID NO: 3368 - RNA, 1701 nt, Artificial Sequence; identical to SEQ ID NO: 116
  derived and/or modified CDS sequence (AUadapt) from InfluenzaA__ACU17126__HA

SEQ ID NO: 3369 - RNA, 1701 nt, Artificial Sequence; identical to SEQ ID NO: 3005
  derived and/or modified CDS sequence (AUadapt) from InfluenzaA__ACU17187__HA

SEQ ID NO: 3370 - RNA, 1701 nt, Artificial Sequence; identical to SEQ ID NO: 116
  derived and/or modified CDS sequence (AUadapt) from InfluenzaA__ACU17258__HA

SEQ ID NO: 3371 - RNA, 1701 nt, Artificial Sequence
  derived and/or modified CDS sequence (AUadapt) from InfluenzaA__ACU17389__HA
auggaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggucgggcaucaucaucuccgacacccccgugcacgacugcaacacggccugccagaccccgaagggcgcgaucaacaccagccugcccuuccacaacauccaccccaucaccaucgggaagugccccaaguacgugaaguccacgaagcugcggcucgccaccggccugcgcaacgucccgucgauccagucccgggggcuguucggcgccaucgccggguucaucgagggcggcuggaccgggaugguggacggcugguacggguaccaccaccagaacgagcagggcagcggguacgccgcggaccucaaguccacccagaacgccaucgacgagaucacgaacaaggugaacucggucaucgagaagaugaacacccaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggcgaagcugaaccgggaggagaucgacggcgugaagcucgaguccacccgcaucuaccagauccuggccaucuacagcaccgucgccucgucccuggugcucguggucagccugggggccaucuccuucuggaugugcagcaacggcucccugcagugccggaucugcaucuga

SEQ ID NO: 3372 - RNA, 1701 nt, Artificial Sequence; identical to SEQ ID NO: 116
  derived and/or modified CDS sequence (AUadapt) from InfluenzaA__ACU17450__HA

SEQ ID NO: 3373 - RNA, 1701 nt, Artificial Sequence; identical to SEQ ID NO: 116
  derived and/or modified CDS sequence (AUadapt) from InfluenzaA__ACU17521__HA

SEQ ID NO: 3374 - RNA, 1701 nt, Artificial Sequence; identical to SEQ ID NO: 62
  derived and/or modified CDS sequence (AUadapt) from InfluenzaA__ACU27041__HA

SEQ ID NO: 3375 - RNA, 1698 nt, Artificial Sequence
  derived and/or modified CDS sequence (AUadapt) from InfluenzaA__ACU27406__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccucgguguccagcuucgagcgguucgagaucuucccgaaggaguccagcuggcccaaccacacggucaccgggguguccgccagcugcucccacaacggcgagucguccuucuaccgcaaccugcuguggcucaccgggaagaacggccuguaccccaaccugagcaaguccuacgccaacaacaaggagaaggaggugcucguccuguggggcgugcaccacccgcccaacaucguggaccagaagacccuguaccggacggagaacgccuacgucagcguggugagcucccacuacucgcgcaaguucacccccgagaucgccaagcggcccaagauccgcgaccaggagggccggaucaacuacuacuggacccuccuggagcccggcgacaccaucaucuucgaggccaacgggaaccugaucgcgccgcgcuacgccuucgcccucucccggggcuucgggagcggcaucaucaacuccaacgcccccauggacaagugcgacgccaagugccagacgccccagggcgcgaucaacagcucccugcccuuccagaacguccacccggugaccaucggggagugccccaaguacgugcgcagcgccaagcugcggauggucaccggccuccgcaacauccccuccauccagucgcgggggcuguucggcgccaucgccggguucaucgagggcggcuggaccgggaugguggacggcugguacggguaccaccaccagaacgagcagggcuccggguacgccgcggaccagaaguccacgcagaacgccaucaacggcaucaccaacaaggugaacagcgucaucgagcgcaugaacacccaguucaccgccgugggcaaggaguucaacaagcuggagcggcgcauggagaaccucaacaagaaggucgacgacggguucaucgacaucuggacguacaacgccgagcugcuggugcuccuggagaacgagcggacccuggacuuccacgacagcaacgugaagaaccucuacgagaaggucaagucccagcugaagaacaacgccaaggagaucggcaacgggugcuucgaguucuaccacaagugcaacgacgagugcauggagagcgugaagaacggcaccuacgacuaccccaaguacuccgaggagucgaagcugaaccgcgagaagaucgacggggugaagcucgaguccaugggcgucuaccagauccuggcgaucuacagcaccguggccagcucccuggugcuccuggucagccugggcgccaucuccuucuggaugugcagcaacgggucccuccagugccggaucugcaucuga

SEQ ID NO: 3376 - RNA, 1698 nt, Artificial Sequence
  derived and/or modified CDS sequence (AUadapt) from InfluenzaA__ACU27407__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccucgguguccagcuucgagcgguucgagaucuucccgaaggaguccagcuggcccaaccacacggucaccgggguguccgccagcugcucccacaacggcgagucguccuucuaccgcaaccugcuguggcucaccgggaagaacggccuguaccccaaccugagcaaguccuacgccaacaacaaggagaaggaggugcucguccuguggggcgugcaccacccgcccaacaucguggaccagaagacccuguaccggacggagaacgccuacgucagcguggugagcucccacuacucgcgcaaguucacccccgagaucgccaagcggcccaagguccgcgaccaggagggccggaucaacuacuacuggacccuccuggagcccggcgacaccaucaucuucgaggccaacgggaaccugaucgcgccgcgcuacgccuucgcccucucccggggcuucgggagcggcaucaucaacuccaacgcccccauggacaagugcgacgccaagugccagacgccccagggcgcgaucaacagcucccugcccuuccagaacgugcacccggugaccaucggggagugccccaaguacguccgcagcgccaagcugcggauggugaccggccuccgcaacauccccuccauccagucgcgggggcuguucggcgccaucgccggguucaucgagggcggcuggaccgggaugguggacggcugguacggguaccaccaccagaacgagcagggcuccggguacgccgcggaccagaaguccacgcagaacgccaucaacggcaucaccaacaaggucaacagcgugaucgagaagaugaacacccaguucaccgccgucggcaaggaguucaacaagcuggagcgccggauggagaaccucaacaagaagguggacgacggguucaucgacaucuggacguacaacgccgagcugcuggugcuccuggagaacgagcgcacccuggacuuccacgacagcaacgucaagaaccucuacgagaaggugaagucccagcugaagaacaacgccaaggagaucggcaacgggugcuucgaguucuaccacaagugcaacgacgagugcauggagagcgugaagaacggcaccuacgacuaccccaaguacuccgaggagucgaagcugaaccgggagaagaucgacggggucaagcucgaguccaugggcguguaccagauccuggcgaucuacagcaccguggccagcucccugguccuccuggugagccugggcgccaucuccuucuggaugugcagcaacgggucccuccagugccgcaucugcaucuga

SEQ ID NO: 3377 - RNA, 1701 nt, Artificial Sequence; identical to SEQ ID NO: 62
  derived and/or modified CDS sequence (AUadapt) from InfluenzaA__ACU29949__HA

SEQ ID NO: 3378 - RNA, 1701 nt, Artificial Sequence
  derived and/or modified CDS sequence (AUadapt) from InfluenzaA__ACU29979__HA
augaaggccauccuggugguccuccuguacaccuucgccgcggccaacgccgacacccugugcaucggcuaccacgccaacaacucgacggacaccguggacaccgugcucgagaagaacgucaccgugacgcacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacgggaccugcuaccccggcgacuucaucgacuacgaggagcuccgggagcagcugucguccgugagcuccuucgagcgcuucgagaucuuccccaagacgucguccuggcccaaccacgacagcaacaagggcgucaccgccgccugcccgcacgcgggcgccaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcaccucccgguacucgaagaaguucaagcccgagaucgcgauccgcccgaagguccgggaccaggagggccgcaugaacuacuacuggacgcugguggagcccggggacaagaucaccuucgaggccaccggcaaccucguggucccccgguacgccuucgccauggagcgcaacgccggguccggcaucaucaucagcgacacccccgugcacgacugcaacacgaccugccagaccccgaagggcgcgaucaacaccucccugcccuuccagaacauccaccccaucacgaucgggaagugccccaaguacgucaagucgaccaagcugcggcucgccaccggccugcgcaacgugccguccauccagagccgggggcuguucggcgccaucgccggguucaucgagggcggcuggaccgggaugguggacggcugguacggguaccaccaccagaacgagcagggcuccggguacgccgcggaccucaagucgacgcagaacgccaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggcgaagcugaaccgggaggagaucgacggcgugaagcucgagagcacccgcaucuaccagauccuggccaucuacuccaccgucgccucgagccuggugcucguggucucccugggggccaucucguucuggaugugcuccaacggcagccugcagugccggaucugcaucuga

SEQ ID NO: 3379 - RNA, 1701 nt, Artificial Sequence; identical to SEQ ID NO: 116
  derived and/or modified CDS sequence (AUadapt) from InfluenzaA__ACU29989__HA

SEQ ID NO: 3380 - RNA, 1704 nt, Artificial Sequence
  derived and/or modified CDS sequence (AUadapt) from InfluenzaA__ACU29999__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgacccgcaucuaccagauccuggcgaucuacuccaccgucgccagcucgcuggugcucguggucucccugggggccaucagcuucuggaugugcuccaacggcagccugcuccagugccggaucugcaucuga

SEQ ID NO: 3381 - RNA, 1704 nt, Artificial Sequence
  derived and/or modified CDS sequence (AUadapt) from InfluenzaA__ACU30009__HA
auggaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcuccucgcgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccucgcugcccuuccacaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcggcuacggcucccugcagugccggaucugcaucuga

SEQ ID NO: 3382 - RNA, 1701 nt, Artificial Sequence; identical to SEQ ID NO: 3274
  derived and/or modified CDS sequence (AUadapt) from InfluenzaA__ACU30019__HA

SEQ ID NO: 3383 - RNA, 1701 nt, Artificial Sequence; identical to SEQ ID NO: 96
  derived and/or modified CDS sequence (AUadapt) from InfluenzaA__ACU30093__HA

SEQ ID NO: 3384 - RNA, 1701 nt, Artificial Sequence
  derived and/or modified CDS sequence (AUadapt) from InfluenzaA__ACU30103__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuaccacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 3385 - RNA, 1704 nt, Artificial Sequence
  derived and/or modified CDS sequence (AUadapt) from InfluenzaA__ACU30112__HA
auggaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccucgcugcccuuccacaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcucgggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagccacauggugcugcuccagugccggaucugcaucuga

SEQ ID NO: 3386 - RNA, 1701 nt, Artificial Sequence
  derived and/or modified CDS sequence (AUadapt) from InfluenzaA__ACU30121__HA
auggaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcuccucgcgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccucgcugcccuuccacaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcucgggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 3387 - RNA, 1701 nt, Artificial Sequence; identical to SEQ ID NO: 3007
  derived and/or modified CDS sequence (AUadapt) from InfluenzaA__ACU31124__HA

SEQ ID NO: 3388 - RNA, 1701 nt, Artificial Sequence; identical to SEQ ID NO: 2946
  derived and/or modified CDS sequence (AUadapt) from InfluenzaA__ACU31143__HA

SEQ ID NO: 3389 - RNA, 1701 nt, Artificial Sequence; identical to SEQ ID NO: 2946
  derived and/or modified CDS sequence (AUadapt) from InfluenzaA__ACU31144__HA

SEQ ID NO: 3390 - RNA, 1701 nt, Artificial Sequence; identical to SEQ ID NO: 2946
  derived and/or modified CDS sequence (AUadapt) from InfluenzaA__ACU31145__HA

SEQ ID NO: 3391 - RNA, 1701 nt, Artificial Sequence; identical to SEQ ID NO: 96
  derived and/or modified CDS sequence (AUadapt) from InfluenzaA__ACU31146__HA

SEQ ID NO: 3392 - RNA, 1701 nt, Artificial Sequence; identical to SEQ ID NO: 116
  derived and/or modified CDS sequence (AUadapt) from InfluenzaA__ACU31147__HA

SEQ ID NO: 3393 - RNA, 1701 nt, Artificial Sequence
  derived and/or modified CDS sequence (AUadapt) from InfluenzaA__ACU31148__HA
augaaggccauccuggugaucaugcucuacaccuucgccaccgcgaacgccgacacgcugugcaucggcuaccacgccaacaacucgaccgacaccgucgacaccgugcuggagaagaacgugacggucacccacuccgugaaccuccuggaggacaagcacaacgggaagcugugcaagcuccgcggcguggcgccccugcaccuggggaagugcaacaucgccggcuggauccucgggaacccggagugcgagagccuguccaccgccucguccuggagcuacaucgucgagaccuccucguccgacaacggcacgugcuaccccggcgacuucaucgacuacgaggagcugcgggagcagcucagcuccgugucguccuucgagcgcuucgagaucuuccccaagaccagcuccuggcccaaccacgacucgaacaagggggugaccgccgccugcccgcacgccggcgcgaaguccuucuacaagaaccugaucuggcuggucaagaaggggaacagcuaccccaagcucuccaagucguacaucaacgacaagggcaaggaggugcuggugcugugggggauccaccaccccagcaccuccgccgaccagcagucgcucuaccagaacgccgacgccuacgucuucgugggcuccagccgguacuccaagaaguucaagcccgagaucgccauccgcccgaaggugcgggaccaggagggccgcaugaacuacuacuggacgcuggucgagcccggggacaagaucaccuucgaggcgaccggcaaccugguggugccccgguacgccuucgccauggagcgcaacgccgggucgggcaucaucaucuccgacacccccguccacgacugcaacacgaccugccagaccccgaagggcgccaucaacaccagccuccccuuccagaacauccaccccaucacgaucgggaagugccccaaguacgugaaguccaccaagcugcggcuggcgaccggccuccgcaacgugccgucgauccagucccgggggcuguucggcgccaucgccggguucaucgagggcggcuggaccgggauggucgacggcugguacggguaccaccaccagaacgagcagggcagcggguacgccgccgaccugaaguccacgcagaacgcgaucgacgagaucaccaacaaggugaacucggugaucgagaagaugaacacccaguucaccgccgucggcaaggaguucaaccaccucgagaagcgcaucgagaaccugaacaagaagguggacgacggcuuccuggacaucuggacguacaacgccgagcuccugguccugcucgagaacgagcggacccuggacuaccacgacuccaacgugaagaaccuguacgagaaggugcgcagccagcucaagaacaacgccaaggagaucgggaacggcugcuucgaguucuaccacaagugcgacaacacgugcauggaguccgucaagaacgggaccuacgacuaccccaaguacucggaggaggccaagcugaaccgggaggagaucgacggcgugaagcuggaguccacccgcaucuaccagauccucgcgaucuacagcaccguggccucgucccugguccugguggugagccucggggccaucuccuucuggaugugcagcaacggcucccugcagugccggaucugcaucuga

SEQ ID NO: 3394 - RNA, 1701 nt, Artificial Sequence; identical to SEQ ID NO: 62
  derived and/or modified CDS sequence (AUadapt) from InfluenzaA__ACU31149__HA

SEQ ID NO: 3395 - RNA, 1701 nt, Artificial Sequence; identical to SEQ ID NO: 62
  derived and/or modified CDS sequence (AUadapt) from InfluenzaA__ACU31150__HA

SEQ ID NO: 3396 - RNA, 1701 nt, Artificial Sequence; identical to SEQ ID NO: 62
  derived and/or modified CDS sequence (AUadapt) from InfluenzaA__ACU31151__HA

SEQ ID NO: 3397 - RNA, 1701 nt, Artificial Sequence; identical to SEQ ID NO: 62
  derived and/or modified CDS sequence (AUadapt) from InfluenzaA__ACU31152__HA

SEQ ID NO: 3398 - RNA, 1707 nt, Artificial Sequence
  derived and/or modified CDS sequence (AUadapt) from InfluenzaA__ACU46644__HA
auggagaagaucgugcugcuguucgccaucgucucgcuggugaaguccgaccagaucugcaucggcuaccacgccaacaacagcaccgagcaggucgacaccaucauggagaagaacgugacggugacccacgcgcaggacauccuggagaagacccacaacgggaagcucugcgaccuggacggcgggaagccccugauccuccgcgacugccggguggccggcuggcugcuggggaacccgaugugcgacgaguucaucaacguccccgagugguccuacaucguggagaaggccaaccccgugaacgaccucugcuaccccggcgacuucaacgacuacgaggagcugaagcaccuccucucgcgcaucaaccacuucgagaagauccagaucaucccgaaguccagcugguccagccacgaggccucccugggcgucucguccgccugccccuaccagggcaagagcuccuucuuccggaacgugguguggcugaucaagaagaacucgaccuaccccacgaucaagcgcuccuacaacaacaccaaccaggaggaccuccugguccugugguggauccaccaccccaacgacgcggccgagcagaccaagcucuaccagaacccgaccacguacaucagcguggggaccuccacccugaaccagcggcuggugccccgcaucgccacccggagcaaggucaacgggcaguccggccgcauggaguucuucuggacgauccucaagcccaacgacgccaucaacuucgagucgaacgggaacuucaucgcgcccgaguacgccuacaagaucgugaagaagggcgacagcaccaucaugaaguccgagcuggaguacggcaacugcaacaccaagugccagaccccgaugggggccaucaacucguccaugcccuuccaccacauccacccccugacgaucggcgagugccccaaguacgucaagagcaaccggcucgugcuggccaccgggcugcgcaacuccccgcagcgggagcgccggcgcaagaagcggggccucuucggcgccaucgcgggguucaucgagggcggguggcagggcaugguggacgggugguacggcuaccaccacagcaacgagcagggcuccggguacgccgccgacaaggagucgacccagaaggccaucgacggcgugaccaacaaggucaacuccaucaucgacaagaugaacacgcaguucgaggccguggggcgcgaguucaaccaccuggagcggcgcaucgagaaccugaacaagaagauggaggacggcuuccucgacguguggaccuacaacgcggagcugcugguccucauggagaacgagcggacccuggacuuccacgacagcaacgugaagaaccuguacgacaagguccgccuccagcugcgggacaacgccaaggagcuggggaacggcugcuucgaguucuaccacaagugcgacgacgagugcauggaguccgugcgcaacggcaccuacgacuacccccaguacucggaggaggcccgccucaagcgggaggagaucuccggggugaagcuggagagcaucggcaucuaccagauccuguccaucuacagcacggucgccuccucgcucgcccuggcgaucaugguggccgggcugucccucuggaugugcagcaacggcagccugcagugccgcaucugcaucuga

SEQ ID NO: 3399 - RNA, 1701 nt, Artificial Sequence
  derived and/or modified CDS sequence (AUadapt) from InfluenzaA__ACU56924__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccgcgagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggcgaucuacuccaccgucgccucgagccuggugcucguggucucccugggggccaucucguucuggaugugcuccaacggcagccugcagugccgcaucugcaucuga

SEQ ID NO: 3400 - RNA, 1701 nt, Artificial Sequence; identical to SEQ ID NO: 3267
  derived and/or modified CDS sequence (AUadapt) from InfluenzaA__ACU56931__HA

SEQ ID NO: 3401 - RNA, 1701 nt, Artificial Sequence; identical to SEQ ID NO: 116
  derived and/or modified CDS sequence (AUadapt) from InfluenzaA__ACU64792__HA

SEQ ID NO: 3402 - RNA, 1701 nt, Artificial Sequence; identical to SEQ ID NO: 96
  derived and/or modified CDS sequence (AUadapt) from InfluenzaA__ACU64801__HA

SEQ ID NO: 3403 - RNA, 1701 nt, Artificial Sequence; identical to SEQ ID NO: 96
  derived and/or modified CDS sequence (AUadapt) from InfluenzaA__ACU64812__HA

SEQ ID NO: 3404 - RNA, 1701 nt, Artificial Sequence; identical to SEQ ID NO: 65
  derived and/or modified CDS sequence (AUadapt) from InfluenzaA__ACU79871__HA

SEQ ID NO: 3405 - RNA, 1701 nt, Artificial Sequence; identical to SEQ ID NO: 2561
  derived and/or modified CDS sequence (AUadapt) from InfluenzaA__ACU79882__HA

SEQ ID NO: 3406 - RNA, 1701 nt, Artificial Sequence; identical to SEQ ID NO: 141
  derived and/or modified CDS sequence (AUadapt) from InfluenzaA__ACU79893__HA

SEQ ID NO: 3407 - RNA, 1701 nt, Artificial Sequence; identical to SEQ ID NO: 141
  derived and/or modified CDS sequence (AUadapt) from InfluenzaA__ACU79904__HA

SEQ ID NO: 3408 - RNA, 1698 nt, Artificial Sequence
  derived and/or modified CDS sequence (AUadapt) from InfluenzaA__ACU79937__HA
augaaggccaagcugcucgugcugcugugcaccuucaccgccacguacgcggacaccaucugcaucggcuaccacgccaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagagccucaucuccaaggagagcugguccuacaucgucgagacccccaaccccgagaacggcacgugcuaccccggcuacuucgccgacuacgaggagcugcgcgagcagcugagcuccgugucguccuucgagcgguucgagaucuucccgaaggagagcuccuggcccaaccacaccgugaccggggucaccgccagcugcucccacaacggcaagagcuccuucuaccgcaaccuccuguggcugacggagaagaacgggcucuaccccaaccugagcaacuccuacgugaacaacaaggagaaggaggugcugguccucuggggcgugcaccaccccucgaacaucggggugcagcgggccaucuaccacaccgagaacgccuacgucagcgugguguccagccacuacucccgccgguucaccccggagaucgccaagcgccccaagguccggggccaggagggccgcaucaacuacuacuggacccugcuggagcccggggacacgaucaucuucgaggcgaacggcaaccucaucgcccccugguacgccuucgcccugagccggggguucggcuccggcaucaucaccagcaacgccccgaugaacgagugcgacgcgaagugccagacgccccagggggccaucaacuccucgcugcccuuccagaacgugcaccccgugaccaucggcgagugcccgaaguacguccgcuccaccaagcuccggauggugaccgggcugcgcaacauccccagcauccagucccggggccuguucggggccaucgccggcuucaucgagggcggguggaccggcaugauggacgggugguacggcuaccaccaccagaacgagcaggggagcggcuacgccgcggaccagaaguccacccagaacgccaucaacggcaucacgaacaaggugaacagcgucaucgagaagaugaacacccaguucaccgccguggggaaggaguucaacaagcucgagcgccggauggagaaccugaacaagaaggucgacgacggcuuccuggacaucuggaccuacaacgccgagcuccuggugcugcucgagaacgagcgcacgcuggacuuccacgacuccaacgugaagaaccuguacgagaaggucaagagccagcucaagaacaacgccaaggagaucgggaacggcugcuucgaguucuaccacaagugcaacaacgagugcauggaguccgugaagaacgggaccuacgacuaccccaaguacucggaggaguccaagcugaaccgggagaagaucgacggcgugaagcuggagagcaugggcgucuaccagauccucgcgaucuacagcaccguggccuccagccuggugcugcucgucucccugggggccaucagcuucuggaugugcuccaacggcagccugcagugccgcaucugcaucuga

SEQ ID NO: 3409 - RNA, 1689 nt, Artificial Sequence
  derived and/or modified CDS sequence (AUadapt) from InfluenzaA__ACU79948__HA
auggccaucaucuaccugauccuccuguucaccgccgugcgcggcgaccagaucugcaucggguaccacgcgaacaacucgaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugucgguccccgagugguccuacaucauggagaaggagaacccccgggacggccucugcuacccggggucguucaacgacuacgaggagcugaagcaccuccuguccucggugaagcacuucgagaaggugaagauccugcccaaggaccgcuggacgcagcacaccaccaccggcgggucccgggccugcgccgucagcggcaaccccuccuucuuccgcaacaugguguggcugacgaagaaggggucggacuaccccguggcgaagggcuccuacaacaacaccucgggcgagcagaugcucaucaucuggggcguccaccacccgaacgacgagaccgagcagcggacccuguaccagaacguggggacguacguguccgucgggaccucgacccugaacaagcgcuccacccccgagaucgccacgcggcccaaggugaacggccagggcgggcgcauggaguucucguggacccuccuggacaugugggacaccaucaacuucgaguccaccggcaaccugaucgcccccgaguacggguucaagaucagcaagcggggcuccucggggaucaugaagacggagggcacccucgagaacugcgagaccaagugccagaccccgcugggcgccaucaacacgacccugcccuuccacaacgugcacccccucaccaucggggagugccccaaguacgucaagucggagaagcuggugcuggcgaccggccuccgcaacgugccgcagaucgagucccgggggcuguucggcgccaucgccggguucaucgagggcggcuggcaggggauggucgacggcugguacggguaccaccacucgaacgaccagggcuccggguacgccgccgacaaggagucgacgcagaaggcguucgacggcaucaccaacaacgugaacuccgugaucgagaagaugaacacccaguucgaggccgucggcaaggaguucagcaaccuggagcgccggcucgagaaccugaacaagaagauggaggacggguuccuggacguguggaccuacaacgccgagcuccuggugcugauggagaacgagcgcacgcucgacuuccacgacuccaacgucaagaaccuguacgacaaggugcggaugcagcugcgcgacaacgucaaggagcucggcaacgggugcuucgaguucuaccacaagugcgacgacgagugcaugaacucggugaagaacggcaccuacgacuaccccaaguacgaggaggaguccaagcugaaccggaacgagaucaagggcgugaagcugucguccaugggggucuaccagauccucgccaucuacgccaccguggcgggcucgcugucccuggccaucaugauggccgggaucucguucuggaugugcuccaacggcagccuccagugccgcaucugcaucuga

SEQ ID NO: 3410 - RNA, 1689 nt, Artificial Sequence
  derived and/or modified CDS sequence (AUadapt) from InfluenzaA__ACU79959__HA
auggccaucaucuaccugauccuccuguucaccgccgugcgcggcgaccagaucugcaucggguaccacgcgaacaacucgaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugucgguccccgagugguccuacaucauggagaaggagaacccccgggacggccucugcuacccggggucguucaacgacuacgaggagcugaagcaccuccuguccucggugaagcacuucgagaaggugaagauccugcccaaggaccgcuggacgcagcacaccaccaccggcgggucccgggccugcgccgucagcggcaaccccuccuucuuccgcaacaugguguggcugacgaagaaggggucggacuaccccguggcgaagggcuccuacaacaacaccucgggcgagcagaugcucaucaucuggggcguccaccacccgaacgacgagaccgagcagcggacccuguaccagaacguggggacguacguguccgucgggaccucgacccugaacaagcgcuccacccccgagaucgccacgcggcccaaggugaacggccagggcgggcgcauggaguucucguggacccuccuggacaugugggacaccaucaacuucgaguccaccggcaaccugaucgcccccgaguacggguucaagaucagcaagcggggcuccucggggaucaugaagacggagggcacccucgagaacugcgagaccaagugccagaccccgcugggcgccaucaacacgacccugcccuuccacaacgugcacccccucaccaucggggagugccccaaguacgucaagucggagaagcuggugcuggcgaccggccuccgcaacgugccgcagaucgagucccgggggcuguucggcgccaucgccggguucaucgagggcggcuggcaggggauggucgacggcugguacggguaccaccacucgaacgaccagggcuccggguacgccgccgacaaggagucgacgcagaaggcguucgacggcaucaccaacaaggugaacuccgugaucgagaagaugaacacccaguucgaggccgucggcaaggaguucagcaaccuggagcgccggcucgagaaccugaacaagaagauggaggacggguuccuggacguguggaccuacaacgccgagcuccuggugcugauggagaacgagcgcacgcucgacuuccacgacuccaacgucaagaaccuguacgacaaggugcggaugcagcugcgcgacaacgucaaggagcucggcaacgggugcuucgaguucuaccacaagugcgacgacgagugcaugaacucggugaagaacggcaccuacgacuaccccaaguacgaggaggaguccaagcugaaccggaacgagaucaagggcgugaagcugucguccaugggggucuaccagauccucgccaucuacgccaccguggcgggcucgcugucccuggccaucaugauggccgggaucucguucuggaugugcuccaacggcagccuccagugccgcaucugcaucuga

SEQ ID NO: 3411 - RNA, 1701 nt, Artificial Sequence
  derived and/or modified CDS sequence (AUadapt) from InfluenzaA__ACU79970__HA
augaagaccaucaucgcccugucguacauccagugccucguguucgcccagaaguuccccggcaacgacaacuccaccgcgacgcugugccuggggcaccacgccgucccgaacggcaccaucgugaagaccaucaccaacgaccagaucgaggugacgaacgccaccgagcucguccagucguccagcaccggggagaucugcgacucgccccaccagauccuggacggcgagaacugcacccugaucgacgcccuccugggggacccccagugcgacggcuuccagaacaagaacugggaccuguucguggagcgcagcaaggccuacuccaacugcuaccccuacgacgugccggacuacgcgucgcuccggucccuggucgccagcuccggcacgcuggaguucaacaacgagucguucaacuggaccggggugacccagaacggcaccuccagcgccugcauccgccgguccaacaacucguucuucuccaagcucaacuggcugacgcacagcaaguucaaguaccccgcccugaacgugaccaugcccaacaacgagaacuucgacaagcucuacaucuggggcguccaccaccccgggaccgacaacgaccagaucuuccuguacgcgcaggccuccgggcgcaucaccgugucgacgaagcggagccagcagaccgugaucccgaacaucggcucccgcccccggguccgcaacauccccucgcggaucuccaucuacuggaccaucgugaagcccggcgacauccugcucaucaacagcaccgggaaccugaucgccccgcgcggcuacuucaagauccgguccgggaaguccuccaucaugcgcucggacgcccccaucggcaagugcaacuccgagugcaucacgcccaacggcagcauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggguucaucgagaacggcugggagggcaugguggacgggugguacggcuuccggcaccagaacuccgaggggaucggccaggccgccgaccucaagucgacccaggcggccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgcgugcaucgggucgauccggaacggcaccuacgaccacgacgucuaccgcgacgaggcccucaacaaccgcuuccagaucaaggggguggagcugaaguccggcuacaaggacuggauccuguggaucagcuucgccaucuccugcuuccuccugugcaucgcccugcucggcuucaucaugugggccugccagaaggggaacauccggugcaacaucugcaucuga

SEQ ID NO: 3412 - RNA, 1698 nt, Artificial Sequence
  derived and/or modified CDS sequence (AUadapt) from InfluenzaA__ACU79981__HA
augaaggugaagcugcucguccugcugugcaccuucaccgccacguacgccgacaccaucugcaucggcuaccacgcgaacaacucgaccgacaccguggacacggugcucgagcgcaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgggagcagcucuccagcguguccagcuucgagcgcuucgagaucuucccgaaggaguccagcuggcccaaccacacggucaccgggguguccgccucgugcucccacaacggcgagagcuccuucuaccggaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugucggucgugagcucccacuacagccgcaaguucacgcccgagaucgccaagcggcccaaggugcgcgaccaggagggccggaucaacuacuacuggacccuccugaagcccggggacaccaucaucuucgaggcgaacggcaaccugaucgccccgcgcuacgccuucgcccucucccggggguucggcagcggcaucaucaacuccaacgcccccauggacaagugcgacgcgaagugccagacgccccagggggccaucaacucgucccugcccuuccagaacguccacccggugaccaucggcgagugccccaaguacgugcgcagcgccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacucggucaucgagaagaugaacacccaguucaccgccguggggaaggaguucaacaagcuggagcgccggauggagaaccucaacaagaaggucgacgacggcuucaucgacaucuggaccuacaacgccgagcugcuggugcuccuggagaacgagcgcacgcuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgggagaagaucgacggcgugaagcucgaguccaugggcgucuaccagauccuggccaucuacucgaccguggccagcucccuggugcuccuggucagccugggggccaucuccuucuggaugugcagcaacggcucccuccagugccgcaucugcaucuga

SEQ ID NO: 3413 - RNA, 1698 nt, Artificial Sequence
  derived and/or modified CDS sequence (AUadapt) from InfluenzaA__ACU79992__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacaaccacaacgggaagcucugccugcugaagggcaaggcgccccuccagcuggggaacugcagcgucgccggcuggauccuggggaacccggagugcggccuccugaucuccaaggagagcugguccuacaucguggagcgccccaaccccgagaacgggaccugcuaccccgggcacuucgccgacuacgaggagcugcgggagcagcucucguccgugagcuccuucgagcgcuucgagaucuucccgaaggagagcuccuggcccaaccacacggucaccggcgugucggccuccugcagccacaacggggaguccagcuucuacaagaaccugcuguggcucaccggcaagaacgggcuguaccccaaccuguccaagucguacgccaacaacaaggagaaggaggugcucguccuguggggcgugcaccacccgcccaacaucggcgaccagaugacccuguaccacaaggagaacgccuacguguccgucgugagcagccacuacucccggaaguucacgcccgagaucgccaagcgccccaaggugcgggaccaggaggggcgcaucaacuacuacuggacccuccuggagcccggcgacaccaucaucuucgaggccaacgggaaccugaucgcgccgcgguacgccuucgcccucucgcgcggcuucggcuccgggaucaucaacagcaacgcccccauggacgagugcgacgccaagugccagacgccccagggcgcgaucaacuccagccugcccuuccagaacguccacccggugaccaucggggagugccccaaguacgugcgguccgccaagcugcgcauggucaccggccuccggaacauccccucgauccagucccgcgggcuguucggcgccaucgccggcuucaucgagggcggcuggaccgggaugguggacggcugguacggguaccaccaccagaacgagcagggcagcggcuacgccgcggaccagaaguccacccagaacgccaucaacgggaucacgaacaaggugaacagcgucaucgagaagaugaacacccaguucaccgccgugggcaaggaguucaacaagcuggagcggcgcauggagaaccucaacaagaaggucgacgacggguucaucgacguguggaccuacaacgccgagcugcuggugcuccuggagaacgagcggacgcuggacuuccacgacuccaacgucaagaaccucuacgagaaggugaagaaccagcugaagaacaacgccaaggagaucggcaacgggugcuucgaguucuaccacaagugcaacgacgagugcauggagucggugaagaacggcaccuacgacuaccccaaguacuccgaggagagcaagcugucccgcgagaagaucgacggcgucaagcucgagagcauggggguguaccagauccuggcgaucuacuccaccguggccucgagccugguccuccuggugucccugggcgccaucagcuucuggaugugcuccaacgggagccuccagugccggaucugcaucuga

SEQ ID NO: 3414 - RNA, 1701 nt, Artificial Sequence; identical to SEQ ID NO: 2679
  derived and/or modified CDS sequence (AUadapt) from InfluenzaA__ACU80003__HA

SEQ ID NO: 3415 - RNA, 1698 nt, Artificial Sequence
  derived and/or modified CDS sequence (AUadapt) from InfluenzaA__ACU80025__HA
augaaggugaagcugcucguccugcugugcaccuucgccgccaccuacgcggacacgaucugcaucggcuaccacgccaacaacucgaccgacaccguggacaccgugcucgagaagaacgucacggugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacaccgucacggggguguccgccucgugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugucggucgugagcucccacuacagccggaaguucacccccgagaucgcgaagcgccccaaggugcgggaccaggagggccgcaucaacuacuacuggacgcuccuggagcccggggacaccaucaucuucgaggccaacggcaaccugaucgccccgcgguacgccuucgcccucucccgcggguucggcagcggcaucaucaacuccaacgcgcccauggacaagugcgacgccaagugccagacgccccagggggccaucaacucgucccugcccuuccagaacguccacccggugaccaucggcgagugccccaaguacgugcggagcgccaagcugcgcauggucaccgggcuccggaacauccccuccauccagagccgcggccuguucggggccaucgcgggcuucaucgagggcggguggaccggcaugguggacgggugguacggcuaccaccaccagaacgagcagggguccggcuacgccgccgaccagaaguccacccagaacgccaucaacggcaucaccaacaaggugaacucggucaucgagaagaugaacacgcaguucaccgccguggggaaggaguucaacaagcuggagcggcgcauggagaaccucaacaagaaggucgacgacggcuucaucgacaucuggaccuacaacgcggagcugcuggugcuccuggagaacgagcggacccuggacuuccacgacagcaacgugaagaaccucuacgagaaggucaagucccagcugaagaacaacgccaaggagaucgggaacggcugcuucgaguucuaccacaagugcaacgacgagugcauggagagcgugaagaacgggacguacgacuaccccaaguacuccgaggagagcaagcugaaccgcgagaagaucgacggcgugaagcucgaguccaugggcgucuaccagauccuggccaucuacucgaccguggccagcucccuggugcuccuggucagccugggggccaucuccuucuggaugugcagcaacggcucccuccagugccggaucugcaucuga

SEQ ID NO: 3416 - RNA, 1701 nt, Artificial Sequence
  derived and/or modified CDS sequence (AUadapt) from InfluenzaA__ACU80036__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacaacucguucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccagcgggcggaucaccguguccacgaagcgcucgcagcagaccgugaucccgaacaucggcagccggccccgcguccggaacauccccucccgcaucucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcagcuccgagugcaucacgcccaacggcucgauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggcggggccaggccgccgaccugaaguccacccaggcggccaucgaccagaucaacgggaagcugaaccgccucaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgccgaggacaucgggaacggcugcuucaagaucuaccacaagugcgacaacgcgugcaucgggucgauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 3417 - RNA, 1698 nt, Artificial Sequence; identical to SEQ ID NO: 2888
  derived and/or modified CDS sequence (AUadapt) from InfluenzaA__ACU80047__HA

SEQ ID NO: 3418 - RNA, 1701 nt, Artificial Sequence
  derived and/or modified CDS sequence (AUadapt) from InfluenzaA__ACU80058__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccugcuccaacugcuaccccuacgacgugccggacuacgcgucgcugcggucccucgucgccagcuccgggacgcuggaguucaacaacgagucguucaacuggaccggcgugacccagaacgggaccuccucggccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccucgggccggaucaccguguccacgaagcgcagccagcagaccgugaucccgaacaucggcucgcggccccgcguccggaacauccccucccgcaucagcaucuacuggaccaucgugaagcccggggacauccugcucaucaacuccaccggcaaccugaucgccccgcggggguacuucaagauccgcucgggcaaguccucgaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacucggagggcaucgggcaggccgccgaccugaaguccacccaggcggccaucaaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacacgaucgaccucaccgacucggagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 3419 - RNA, 1698 nt, Artificial Sequence; identical to SEQ ID NO: 2733
  derived and/or modified CDS sequence (AUadapt) from InfluenzaA__ACU80069__HA

SEQ ID NO: 3420 - RNA, 1698 nt, Artificial Sequence
  derived and/or modified CDS sequence (AUadapt) from InfluenzaA__ACU80080__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccucgguguccagcuucgagcgguucgagaucuucccgaaggaguccagcuggcccaaccacacggucaccgggguguccgccagcugcucccacaacggcgagucguccuucuaccgcaaccugcuguggcucaccgggaagaacggccuguaccccaaccugagcaaguccuacgccaacaacaaggagaaggaggugcucguccuguggggcgugcaccacccgcccaacaucguggaccagaagacccuguaccggacggagaacgccuacgucagcguggugagcucccacuacucgcgcaaguucacccccgagaucgccaagcggcccaagguccgcgaccaggagggccggaucaacuacuacuggacccuccuggagcccggcgacaccaucaucuucgaggccaacgggaaccugaucgcgccgcgcuacgccuucgcccucucccggggcuucgggagcggcaucaucaacuccaacgcccccauggacaagugcgacgccaagugccagacgccccagggcgcgaucaacagcucccugcccuuccagaacgugcacccggugaccaucggggagugccccaaguacguccgcagcgccaagcugcggauggugaccggccuccgcaacauccccuccauccagucgcgggggcuguucggcgccaucgccggguucaucgagggcggcuggaccgggaugguggacggcugguacggguaccaccaccagaacgagcagggcuccggguacgccgcggaccagaaguccacgcagaacgccaucaacggcaucaccaacaaggucaacagcgugaucgagaagaugaacacccaguucaccgccgucggcaaggaguucaacaagcuggagcgccggauggagaaccucaacaagaagguggacgacggguucaucgacaucuggacguacaacgccgagcugcuggugcuccuggagaacgagcgcacccuggacuuccacgacagcaacgucaagaaccucuacgagaaggugaagucccagcugaagaacaacgccaaggagaucggcaacgggugcuucgaguucuaccacaagugcaacgacgagugcauggagagcgugaagaacggcaccuacgacuaccccaaguacuccgaggagucgaagcugaaccgggagaagaucgacgggaucaagcucgaguccaugggcgucuaccagauccuggcgaucuacagcaccguggccagcucccuggugcuccuggucagccugggcgccaucuccuucuggaugugcagcaacgggucccuccagugccgcaucugcaucuga

SEQ ID NO: 3421 - RNA, 1698 nt, Artificial Sequence; identical to SEQ ID NO: 3019
  derived and/or modified CDS sequence (AUadapt) from InfluenzaA__ACU80091__HA

SEQ ID NO: 3422 - RNA, 1701 nt, Artificial Sequence; identical to SEQ ID NO: 2782
  derived and/or modified CDS sequence (AUadapt) from InfluenzaA__ACU80102__HA

SEQ ID NO: 3423 - RNA, 1701 nt, Artificial Sequence
  derived and/or modified CDS sequence (AUadapt) from InfluenzaA__ACU80113__HA
augaagaccaucaucgcccugucguacauccucugccugguguucgcccagaaguuccccggcaacgacaacuccaccgcgacgcugugccucgggcaccacgccgucccgaacggcaccaucgugaagaccaucaccaacgaccagaucgaggugacgaacgccaccgagcugguccagagcuccucgaccggggagaucugcgacagcccccaccagauccuggacggcgagaacugcacccucaucgacgcccugcugggggacccccagugcgacggcuuccagaacaagaacugggaccucuucguggagcgcucgaaggccuacuccaacugcuaccccuacgacgugccggacuacgcgagccugcggucccuggucgccucguccggcacgcucgaguucaacaacgagagcuucaacuggaccggggugacccagaacggcaccuccucggccugcauccgccgguccaacaacagcuucuucucccgccugaacuggcugacgcacucgaaguucaaguaccccgcccucaacgugaccaugcccaacaacgagaacuucgacaagcuguacaucuggggcguccaccaccccgggaccgacaacgaccagaucuuccuguacgcgcaggccuccgggcggaucaccgugagcacgaagcgcucgcagcagaccgugaucccgaacaucggcucccggccccgcguccggaacauccccagccgcaucuccaucuacuggaccaucgugaagcccggcgacauccuccugaucaacucgaccgggaaccugaucgccccgcggggcuacuucaagauccgcuccgggaaguccuccaucaugcggagcgacgcccccaucggcaagugcaacuccgagugcaucacgcccaacggcucgauccccaacgacaagccguuccagaacgugaaccgcaucaccuacggggccugcccccgguacgucaagcagaacacccucaagcuggcgaccggcaugcgcaacgugcccgagaagcagacgcgggggaucuucggcgccaucgccggguucaucgagaacggcugggagggcaugguggacgggugguacggcuuccgccaccagaacuccgaggggaucggccaggccgccgaccucaagagcacccaggcggccaucgaccagaucaacgggaagcugaaccggcugaucggcaagaccaacgagaaguuccaccagaucgagaaggaguucuccgagaucgagggccgcauccaggaccuggagaaguacgucgaggacaccaagaucgaccucuggucguacaacgccgagcugcugguggcccucgagaaccagcacacgaucgaccugaccgacuccgagaugaacaagcuguucgagaagaccaagaagcagcuccgggagaacgccgaggacauggggaacggcugcuucaagaucuaccacaagugcgacaacgcgugcaucgggagcauccgcaacggcaccuacgaccacgacguguaccgcgacgaggcccugaacaaccgguuccagaucaagggggucgagcugaaguccggcuacaagaacuggauccucuggaucagcuucgccaucuccugcuuccugcugugcaucgcccuccugggcuucaucaugugggccugccagaaggggaacauccgcugcaacaucugcaucuga

SEQ ID NO: 3424 - RNA, 1701 nt, Artificial Sequence
  derived and/or modified CDS sequence (AUadapt) from InfluenzaA__ACU80135__HA
augaagaccaucaucgcccugucguacauccucugccugguguucgcccagaaguuccccggcaacgacaacuccaccgcgacgcugugccucgggcaccacgccgucccgaacggcaccauggugaagaccaucaccaacgaccagaucgaggugacgaacgccaccgagcugguccagagcuccucgaccggggagaucugcgacagcccccaccagauccuggacggcgagaacugcacccucaucgacgcccugcugggggacccccagugcgacggcuuccagaacaagaacugggaccucuucguggagcgcucgaaggccuacuccaacugcuaccccuacgacgugccggacuacgcgagccugcggucccuggucgccucguccggcacgcucgaguucaacaacgagagcuucaacuggaccggggugacccagaacggcaccuccucggccugcauccgccgguccaacaacagcuucuucucccgccugaacuggcugacgcacucgaaguucaaguaccccgcccucaacgugaccaugcccaacaacgagaacuucgacaagcuguacaucuggggcguccaccaccccgggaccgacaacgaccagaucuuccuguacgcgcaggccuccgggcggaucaccgugagcacgaagcgcucgcagcagaccgugaucccgaacaucggcucccggccccgcguccggaacauccccagccgcaucuccaucuacuggaccaucgugaagcccggcgacauccuccugaucaacucgaccgggaaccugaucgccccgcggggcuacuucaagauccgcuccgggaaguccuccaucaugcggagcgacgcccccaucggcaagugcaacuccgagugcaucacgcccaacggcucgauccccaacgacaagccguuccagaacgugaaccgcaucaccuacggggccugcccccgguacgucaagcagaacacccucaagcuggcgaccggcaugcgcaacgugcccgagaagcagacgcgggggaucuucggcgccaucgccggguucaucgagaacggcugggagggcaugguggacgggugguacggcuuccgccaccagaacuccgaggggaucggccaggccgccgaccucaagagcacccaggcggccaucgaccagaucaacgggaagcugaaccggcugaucggcaagaccaacgagaaguuccaccagaucgagaaggaguucuccgaggucgagggccgcauccaggaccuggagaaguacguggaggacaccaagaucgaccucuggucguacaacgccgagcugcugguggcccucgagaaccagcacacgaucgaccugaccgacuccgagaugaacaagcuguucgagaagaccaagaagcagcuccgggagaacgccgaggacauggggaacggcugcuucaagaucuaccacaagugcgacaacgcgugcaucgggagcauccgcaacggcaccuacgaccacgacgucuaccgcgacgaggcccugaacaaccgguuccagaucaaggggguggagcugaaguccggcuacaaggacuggauccucuggaucagcuucgccaucuccugcuuccugcugugcaucgcccuccugggcuucaucaugugggccugccagaaggggaacauccgcugcaacaucugcaucuga

SEQ ID NO: 3425 - RNA, 1701 nt, Artificial Sequence
  derived and/or modified CDS sequence (AUadapt) from InfluenzaA__ACU80146__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcacucgaaguucaaguaccccgcccugaacgugaccaugcccaacaacgaggaguucgacaagcuguacaucuggggcguccaccaccccgggaccgacaacgaccagaucuuccucuacgcgcaggccuccgggcggaucaccgugagcacgaagcgcucgcagcagaccgugaucccgaacaucggcucccggccccgcguccggaacauccccagccgcaucuccaucuacuggaccaucgugaagcccggcgacauccugcugaucaacucgaccgggaaccucaucgccccgcggggcuacuucaagauccgcuccgggaaguccuccaucaugcggucggacgcccccaucggcaagugcaacuccgagugcaucacgcccaacggcagcauccccaacgacaagccguuccagaacgugaaccgcaucaccuacggggccugcccccgguacgucaagcagaacacccugaagcuggcgaccggcaugcgcaacgugcccgagaagcagacgcgggggaucuucggcgccaucgccggguucaucgagaacggcugggagggcaugguggacgggugguacggcuuccgccaccagaacuccgaggggaucggccaggccgccgaccucaagucgacccaggcggccaucgaccagaucaacgggaagcugaaccggcugaucggcaagaccaacgagaaguuccaccagaucgagaaggaguucuccgaggucgagggccgcauccaggaccucgagaaguacguggaggacaccaagaucgaccuguggagcuacaacgccgagcugcucguggcccuggagaaccagcacacgaucgaccugaccgacuccgagaugaacaagcuguucgagaagaccaagaagcagcuccgggagaacgccgaggacauggggaacggcugcuucaagaucuaccacaagugcgacaacgcgugcaucgggucgauccgcaacggcaccuacgaccacgacgucuaccgcgacgaggcccugaacaaccgguuccagaucaaggggguggagcucaaguccggcuacaaggacuggauccuguggaucagcuucgccaucuccugcuuccugcucugcguggcccugcugggccucaucaugugggccugccagaaggggaacauccgcugcaacaucugcaucuga

SEQ ID NO: 3426 - RNA, 1701 nt, Artificial Sequence; identical to SEQ ID NO: 2679
  derived and/or modified CDS sequence (AUadapt) from InfluenzaA__ACU80157__HA

SEQ ID NO: 3427 - RNA, 1698 nt, Artificial Sequence; identical to SEQ ID NO: 3415
  derived and/or modified CDS sequence (AUadapt) from InfluenzaA__ACU80168__HA

SEQ ID NO: 3428 - RNA, 1701 nt, Artificial Sequence; identical to SEQ ID NO: 2679
  derived and/or modified CDS sequence (AUadapt) from InfluenzaA__ACU80179__HA

SEQ ID NO: 3429 - RNA, 1701 nt, Artificial Sequence
  derived and/or modified CDS sequence (AUadapt) from InfluenzaA__ACU80190__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacaacucguucuucucccgccugaacuggcucacgcacagcaaguucaaguaccccgcccugaacgugaccaugcccaacaacgaggaguucgacaagcuguacaucuggggcguccaccaccccgggaccgacaacgaccagaucuuccucuacgcgcaggccuccgggcggaucaccgugucgacgaagcgcagccagcagaccgugaucccgaacaucggcucccggccccgcguccggaacauccccucgcgcaucuccaucuacuggaccaucgugaagcccggcgacauccugcugaucaacagcaccgggaaccucaucgccccgcggggcuacuucaagauccgcuccgggaaguccuccaucaugcggucggacgcccccaucggcaagugcaacuccgagugcaucacgcccaacggcagcauccccaacgacaagccguuccagaacgugaaccgcaucaccuacggggccugcccccgguacgucaagcagaacacccugaagcuggcgaccggcaugcgcaacgugcccgagaagcagacgcgggggaucuucggcgccaucgccggguucaucgagaacggcugggagggcaugguggacgggugguacggcuuccgccaccagaacuccgaggggaucggccaggccgccgaccucaagucgacccaggcggccaucgaccagaucaacgggaagcugaaccggcugaucggcaagaccaacgagaaguuccaccagaucgagaaggaguucuccgaggucgagggccgcauccaggaccucgagaaguacguggaggacaccaagaucgaccuguggagcuacaacgccgagcugcucguggcccuggagaaccagcacacgaucgaccugaccgacuccgagaugaacaagcuguucgagaagaccaagaagcagcuccgggagaacgccgaggacauggggaacggcugcuucaagaucuaccacaagugcgacaacgcgugcaucgggucgauccgcaacggcaccuacgaccacgacgucuaccgcgacgaggcccugaacaaccgguuccagaucaaggggaucgagcucaaguccggcuacaaggacuggauccuguggaucagcuucgccaucuccugcuuccugcucugcguggcccugcugggcuucaucaugugggccugccagaaggggaacauccgcugcaacaucugcaucuga

SEQ ID NO: 3430 - RNA, 1701 nt, Artificial Sequence
  derived and/or modified CDS sequence (AUadapt) from InfluenzaA__ACU80201__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccucggggcggaucaccguguccacgaagcgcagccagcagaccgugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggcggggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacaucaagugcaacaucugcaucuga

SEQ ID NO: 3431 - RNA, 1701 nt, Artificial Sequence; identical to SEQ ID NO: 2679
  derived and/or modified CDS sequence (AUadapt) from InfluenzaA__ACU80212__HA

SEQ ID NO: 3432 - RNA, 1698 nt, Artificial Sequence
  derived and/or modified CDS sequence (AUadapt) from InfluenzaA__ACU80234__HA
augaaggugaagcugcucguccugcugugcaccuucgccgccaccuacgcggacacgaucugcaucggcuaccacgccaacaacucgaccgacaccguggacaccgugcucgagaagaacgucacggugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacaccgucacggggguguccgccucgugcucccacaacggcgagagcuccuucuacaagaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugucggucgugagcucccacuacagccgcaaguucacccccgagaucgcgaagcggcccaaggugcgcgaccaggagggccggaucaacuacuacuggacgcuccuggagcccggggacaccaucaucuucgaggccaacggcaaccugaucgccccgcgcuacgccuucgcccucucccggggguucggcagcggcaucaucaacuccaacgcgcccauggacaagugcgacgccaagugccagacgccccagggggccaucaacucgucccugcccuuccagaacguccacccggugaccaucggcgagugccccaaguacgugcgcagcgccaagcugcggauggucaccgggcuccgcaacauccccuccauccagagccggggccuguucggggccaucgcgggcuucaucgagggcggguggaccggcaugguggacgggugguacggcuaccaccaccagaacgagcagggguccggcuacgccgccgaccagaaguccacccagaacgccaucaacggcaucaccaacaaggugaacucggucaucgagaagaugaacacgcaguucaccgccguggggaaggaguucaacaagcuggagcgccggauggagaaccucaacaagaaggucgacgacggcuucaucgacaucuggaccuacaacgcggagcugcuggugcuccuggagaacgagcgcacccuggacuuccacgacagcaacgugaagaaccucuacgagaaggucaagucccagcugaagaacaacgccaaggagaucgggaacggcugcuucgaguucuaccacaagugcaacgacgagugcauggagagcgugaagaacgggacguacgacuaccccaaguacuccgaggagagcaagcugaaccgggagaagaucgacggcgugaagcucgaguccaugggcgucuaccagauccuggccaucuacucgaccguggccagcucccuggugcuccuggucagccugggggccaucuccuucuggaugugcagcaacggcucccuccagugccgcaucugcaucuga

SEQ ID NO: 3433 - RNA, 1701 nt, Artificial Sequence
  derived and/or modified CDS sequence (AUadapt) from InfluenzaA__ACU80245__HA
augaagaccaucaucgcccugucguacauccucugccugguguucgcccagaaguuccccggcaacgacaacuccaccgcgacgcugugccucgggcaccacgccgucccgaacggcaccaucgugaagaccaucaccaacgaccagaucgaggugacgaacgccaccgagcugguccagagcuccucgaccggggagaucugcgacagcccccaccagauccuggacggcgagaacugcacccucaucgacgcccugcugggggacccccagugcgacggcuuccagaacaagaacugggaccucuucguggagcgcucgaaggccuacuccaacugcuaccccuacgacgugccggacuacgcgagccugcggucccuggucgccucguccggcacgcucgaguucaacaacgagagcuucaacuggaccggggugacccagaacggcaccuccucggccugcauccgccgguccaacaacagcuucuucucccgccugaacuggcugacgcacucgaaguucaaguaccccgcccucaacgugaccaugcccaacaacgagaacuucgacaagcuguacaucuggggcguccaccaccccgggaccgacaacgaccagaucuuccuguacgcgcaggccuccgggcggaucaccgugagcacgaagcgcucgcagcagaccgugaucccgaacaucggcucccggccccgcguccggaacauccccagccgcaucuccaucuacuggaccaucgugaagcccggcgacauccuccugaucaacucgaccgggaaccugaucgccccgcggggcuacuucaagauccgcuccgggaaguccuccaucaugcggagcgacgcccccaucggccgcugcaacuccgagugcaucacgcccaacggcucgauccccaacgacaagccguuccagaacgugaaccggaucaccuacggggccugcccccgcuacgucaagcagaacacccucaagcuggcgaccggcaugcggaacgugcccgagaagcagacgcgcgggaucuucggcgccaucgccggguucaucgagaacggcugggagggcaugguggacgggugguacggcuuccggcaccagaacuccgaggggaucggccaggccgccgaccucaagagcacccaggcggccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccucuggucguacaacgccgagcugcugguggcccucgagaaccagcacacgaucgaccugaccgacuccgagaugaacaagcuguucgagaagaccaagaagcagcuccgcgagaacgccgaggacauggggaacggcugcuucaagaucuaccacaagugcgacaacgcgugcaucgggagcauccgcaacggcaccuacgaccacgacgucuaccgggacgaggcccugaacaaccgcuuccagaucaaggggguggagcugaaguccggcuacaaggacuggauccucuggaucagcuucgccaucuccugcuuccugcugugcaucgcccuccugggcuucaucaugugggccugccagaaggggaacauccggugcaacaucugcaucuga

SEQ ID NO: 3434 - RNA, 1701 nt, Artificial Sequence; identical to SEQ ID NO: 2782
  derived and/or modified CDS sequence (AUadapt) from InfluenzaA__ACU80256__HA

SEQ ID NO: 3435 - RNA, 1698 nt, Artificial Sequence; identical to SEQ ID NO: 2733
  derived and/or modified CDS sequence (AUadapt) from InfluenzaA__ACU80267__HA

SEQ ID NO: 3436 - RNA, 1698 nt, Artificial Sequence; identical to SEQ ID NO: 3415
  derived and/or modified CDS sequence (AUadapt) from InfluenzaA__ACU80278__HA

SEQ ID NO: 3437 - RNA, 1701 nt, Artificial Sequence; identical to SEQ ID NO: 2679
  derived and/or modified CDS sequence (AUadapt) from InfluenzaA__ACU80289__HA

SEQ ID NO: 3438 - RNA, 1701 nt, Artificial Sequence; identical to SEQ ID NO: 2782
  derived and/or modified CDS sequence (AUadapt) from InfluenzaA__ACU80300__HA

SEQ ID NO: 3439 - RNA, 1701 nt, Artificial Sequence
  derived and/or modified CDS sequence (AUadapt) from InfluenzaA__ACU80311__HA
augcgcaccaucaucgcccugucguacauccucugccugguguucgcccagaaguuccccggcaacgacaacuccaccgcgacgcugugccucgggcaccacgccgucccgaacggcaccaucgugaagaccaucaccaacgaccagaucgaggugacgaacgccaccgagcugguccagagcuccucgaccggggagaucugcgacagcccccaccagauccuggacggcgagaacugcacccucaucgacgcccugcugggggacccccagugcgacggcuuccagaacaagaacugggaccucuucguggagcggucgaaggccuacuccaacugcuaccccuacgacgugccggacuacgcgagccugcgcucccuggucgccucguccggcacgcucgaguucaacaacgagagcuucaacuggaccggggugacccagaacggcaccuccucggccugcauccggcgcuccaacaacagcuucuucucccggcugaacuggcugacgcacucgaaguucaaguaccccgcccucaacgugaccaugcccaacaacgagaacuucgacaagcuguacaucuggggcguccaccaccccgggaccgacaacgaccagaucuuccuguacgcgcaggccuccgggcgcaucaccgugagcacgaagcggucgcagcagaccgugaucccgaacaucggcucccgcccccggguccgcaacauccccagccggaucuccaucuacuggaccaucgugaagcccggcgacauccuccugaucaacucgaccgggaaccugaucgccccgcgcggcuacuucaagauccgguccgggaaguccuccaucaugcgcagcgacgcccccaucggcaagugcaacuccgagugcaucacgcccaacggcucgauccccaacgacaagccguuccagaacgugaaccggaucaccuacggggccugcccccgcuacgucaagcagaacacccucaagcuggcgaccggcaugcggaacgugcccgagaagcagacgcgcgggaucuucggcgccaucgccggguucaucgagaacggcugggagggcaugguggacgggugguacggcuuccggcaccagaacuccgaggggaucggccaggccgccgaccucaagagcacccaggcggccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccucuggucguacaacgccgagcugcugguggcccucgagaaccagcacacgaucgaccugaccgacuccgagaugaacaagcuguucgagaagaccaagaagcagcuccgcgagaacgccgaggacauggggaacggcugcuucaagaucuaccacaagugcgacaacgcgugcaucgggagcauccgcaacggcaccuacgaccacgacgucuaccgggacgaggcccugaacaaccgcuuccagaucaaggggguggagcugaaguccggcuacaaggacuggauccucuggaucagcuucgccaucuccugcuuccugcugugcaucgcccuccugggcuucaucaugugggccugccagaaggggaacauccggugcaacaucugcaucuga

SEQ ID NO: 3440 - RNA, 1701 nt, Artificial Sequence; identical to SEQ ID NO: 2782
  derived and/or modified CDS sequence (AUadapt) from InfluenzaA__ACU80322__HA

SEQ ID NO: 3441 - RNA, 1701 nt, Artificial Sequence; identical to SEQ ID NO: 2679
  derived and/or modified CDS sequence (AUadapt) from InfluenzaA__ACU80333__HA

SEQ ID NO: 3442 - RNA, 1701 nt, Artificial Sequence; identical to SEQ ID NO: 2782
  derived and/or modified CDS sequence (AUadapt) from InfluenzaA__ACU80344__HA

SEQ ID NO: 3443 - RNA, 1701 nt, Artificial Sequence; identical to SEQ ID NO: 2782
  derived and/or modified CDS sequence (AUadapt) from InfluenzaA__ACU80355__HA

SEQ ID NO: 3444 - RNA, 1701 nt, Artificial Sequence; identical to SEQ ID NO: 2782
  derived and/or modified CDS sequence (AUadapt) from InfluenzaA__ACU80366__HA

SEQ ID NO: 3445 - RNA, 1701 nt, Artificial Sequence
  derived and/or modified CDS sequence (AUadapt) from InfluenzaA__ACU80377__HA
augaagaccaucaucgcccugucguacauccucugccugguguucgcccagaaguuccccggcaacgacaacuccaccgcgacgcugugccucgggcaccacgccgucccgaacggcaccaucgugaagaccaucaccaacgaccagaucgaggugacgaacgccaccgagcugguccagagcuccucgaccggggagaucugcgacagcccccaccagauccuggacggcgagaacugcacccucaucgacgcccugcugggggacccccagugcgacggcuuccagaacaagaacugggaccucuucguggagcgcucgaaggccuacuccaacugcuaccccuacgacgugccggacuacgcgagccugcggucccuggucgccagcuccggcacgcucgaguucaacaacgagucguucaacuggaccggggugacccagaacggcaccuccagcgccugcauccgccgguccaacaacucguucuucucccgccugaacuggcugacgcacagcaaguucaaguaccccgcccucaacgugaccaugcccaacaacgagaacuucgacaagcuguacaucuggggcguccaccaccccgggaccgacaacgaccagaucuuccuguacgcgcaggccuccgggcggaucaccgugucgacgaagcgcagccagcagaccgugaucccgaacaucggcucccggccccgcguccggaacauccccagccgcaucuccaucuacuggaccaucgugaagcccggcgacauccuccugaucaacucgaccgggaaccugaucgccccgcggggcuacuucaagauccgcuccgggaaguccuccaucaugcggagcgacgcccccaucggcaagugcaacuucgagugcaucacgcccaacggcuccauccccaacgacaagccguuccagaacgugaaccgcaucaccuacggggccugcccccgguacgucaagcagaacacccucaagcuggcgaccggcaugcgcaacgugcccgagaagcagacgcgggggaucuucggcgccaucgccggguucaucgagaacggcugggagggcaugguggacgggugguacggcuuccgccaccagaacucggaggggaucggccaggccgccgaccugaaguccacccaggcggccaucgaccagaucaacgggaagcucaaccggcugaucggcaagaccaacgagaaguuccaccagaucgagaaggaguucagcgaggucgagggccgcauccaggaccuggagaaguacguggaggacaccaagaucgaccucugguccuacaacgccgagcugcugguggcccucgagaaccagcacacgaucgaccugaccgacucggagaugaacaagcuguucgagaagacccggaagcagcuccgcgagaacgccgaggacauggggaacggcugcuucaagaucuaccacaagugcgacaacgcgugcaucggguccauccgcaacggcaccuacgaccacgacgucuaccgggacgaggcccugaacaaccgcuuccagaucaaggggguggagcucaagagcggcuacaaggacuggauccuguggaucuccuucgccaugagcugcuuccugcugugcaucgcccuccugggcuucaucaugugggccugccagaaggggaacauccggugcaacaucugcaucuga

SEQ ID NO: 3446 - RNA, 1701 nt, Artificial Sequence; identical to SEQ ID NO: 2782
  derived and/or modified CDS sequence (AUadapt) from InfluenzaA__ACU80388__HA

SEQ ID NO: 3447 - RNA, 1701 nt, Artificial Sequence; identical to SEQ ID NO: 2679
  derived and/or modified CDS sequence (AUadapt) from InfluenzaA__ACU80399__HA

SEQ ID NO: 3448 - RNA, 1698 nt, Artificial Sequence
  derived and/or modified CDS sequence (AUadapt) from InfluenzaA__ACU80410__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccucguggcccaaccacacggucaccgggguguccgccagcugcucccacaacggcgagagcuccuucuaccgcaaccugcuguggcucaccgggaagaacggccuguaccccaaccugucgaaguccuacgccaacaacaaggagaaggaggugcucguccuguggggcgugcaccacccgcccaacaucggcgaccagaaggcccuguaccacaccgagaacgccuacgugagcgucgugagcucccacuacucgcggaaguucacgcccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacaagugcgacgcgaagugccagacgccccagggggccaucaacagcucccugcccuuccagaacguccacccggugaccaucggcgagugccccaaguacgugcggucggccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacagcgucaucgagaagaugaacacccaguucaccgccguggggaaggaguucaacaagcuggagcggcgcauggagaaccucaacaagaaggucgacgacggcuucaucgacaucuggaccuacaacgccgagcugcuggugcuccuggagaacgagcggacgcuggacuuccacgacucgaacgugaagaaccucuacgagaaggucaagaaccagcugaagaacaacgcgaaggagaucgggaacggcugcuucgaguucuaccacaagugcaacgacgagugcauggaguccgugaagaacgggaccuacgacuaccccaaguacagcgaggaguccaagcugaaccgcgagaagaucgacggcgugaagcucgagagcaugggcgucuaccagauccuggccaucuacuccaccguggccucgagccuggugcuccuggucucccugggggccaucagcuucuggaugugcuccaacggcagccuccagugccggaucugcaucuga

SEQ ID NO: 3449 - RNA, 1701 nt, Artificial Sequence
  derived and/or modified CDS sequence (AUadapt) from InfluenzaA__ACU80424__HA
augaagaccaucaucgcccugucguacauccucugccugguguucgcccagaaguuccccggcaacgacaacuccaccgcgacgcugugccucgggcaccacgccgucccgaacggcaccaucgugaagaccaucaccaacgaccagaucgaggugacgaacgccaccgagcugguccagagcuccucgaccggggagaucugcgacagcccccaccagauccuggacggcgagaacugcacccucaucgacgcccugcugggggacccccagugcgacggcuuccagaacaagaacugggaccucuucguggagcgcucgaaggccuacuccaacugcuaccccuacgacgugccggacuacgcgagccugcggucccuggucgccagcuccggcacgcucgaguucaacaacgagucguucaacuggaccggggugacccagaacggcaccuccagcgccugcauccgccgguccaacaacucguucuucucccgccugaacuggcugacgcacagcaaguucaaguaccccgcccucaacgugaccaugcccaacaacgagaacuucgacaagcuguacaucuggggcguccaccaccccgggaccgacaacgaccagaucuuccuguacgcgcaggccuccgggcggaucaccgugucgacgaagcgcagccagcagaccgugaucccgaacaucggcucccggccccgcguccggaacauccccagccgcaucuccaucuacuggaccaucgugaagcccggcgacauccuccugaucaacucgaccgggaaccugaucgccccgcggggcuacuucaagauccgcuccgggaaguccuccaucaugcggagcgacgcccccaucggcaagugcaacuucgagugcaucacgcccaacggcuccauccccaacgacaagccguuccagaacgugaaccgcaucaccuacggggccugcccccgguacgucaagcagaacacccucaagcuggcgaccggcaugcgcaacgugcccgagaagcagacgcgggggaucuucggcgccaucgccggguucaucgagaacggcugggagggcaugguggacgggugguacggcuuccgccaccagaacucggaggggaucggccaggccgccgaccugaaguccacccaggcggccaucgaccagaucaacgggaagcucaaccggcugaucggcaagaccaacgagaaguuccaccagaucgagaaggaguucagcgaggucgagggccgcauccaggaccuggagaaguacguggaggacaccaagaucgaccucugguccuacaacgccgagcugcugguggcccucgagaaccagcacacgaucgaccugaccgacucggagaugaacaagcuguucgagaagacccggaagcagcuccgcgagaacgccgaggacauggggaacggcugcuucaagaucuaccacaagugcgacaacgcgugcaucggguccauccgcaacggcaccuacgaccacgacgucuaccgggacgaggcccugaacaaccgcuuccagaucaaggggguggagcucaagagcggcuacaaggacuggauccuguggaucuccuucgccaucagcugcuuccugcugugcaucgcccuccugggcuucaucaugugggccugccagaaggggaacauccggugcaacaucugcaucuga

SEQ ID NO: 3450 - RNA, 1701 nt, Artificial Sequence; identical to SEQ ID NO: 3449
  derived and/or modified CDS sequence (AUadapt) from InfluenzaA__ACU80435__HA

SEQ ID NO: 3451 - RNA, 1698 nt, Artificial Sequence
  derived and/or modified CDS sequence (AUadapt) from InfluenzaA__ACU80446__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccucgugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaagacccuguaccacacggagaacgccuacgugucggucgugagcucccacuacagccggaaguucacccccgagaucgccaagcgccccaaggugcgggaccaggagggccgcaucaacuacuacuggacccuccuggagcccggggacaccaucaucuucgaggccaacggcaaccugaucgcgccgcgguacgccuucgcccucucccgcggguucggcagcggcaucaucaacuccaacgcccccauggacaagugcgacgccaagugccagacgccccagggggcgaucaacucgucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgccgcggaccagaaguccacgcagaacgccaucaacggcaucaccaacaaggugaacucggucaucgagaagaugaacacccaguucaccgccguggggaaggaguucaacaagcuggagcggcgcauggagaaccucaacaagaaggucgacgacggcuucaucgacaucuggacguacaacgccgagcugcuggugcuccuggagaacgagcggacccuggacuuccacgacagcaacgugaagaaccucuacgagaaggucaagucccagcugaagaacaacgccaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgugaagcucgaguccauggaggucuaccagauccuggcgaucuacucgaccguggccagcucccuggugcuccuggucagccugggcgccaucuccuucuggaugugcagcaacgggucccuccagugccggaucugcaucuga

SEQ ID NO: 3452 - RNA, 1701 nt, Artificial Sequence; identical to SEQ ID NO: 2679
  derived and/or modified CDS sequence (AUadapt) from InfluenzaA__ACU80458__HA

SEQ ID NO: 3453 - RNA, 1701 nt, Artificial Sequence; identical to SEQ ID NO: 2679
  derived and/or modified CDS sequence (AUadapt) from InfluenzaA__ACU80470__HA

SEQ ID NO: 3454 - RNA, 1701 nt, Artificial Sequence; identical to SEQ ID NO: 2782
  derived and/or modified CDS sequence (AUadapt) from InfluenzaA__ACU80600__HA

SEQ ID NO: 3455 - RNA, 1701 nt, Artificial Sequence; identical to SEQ ID NO: 3449
  derived and/or modified CDS sequence (AUadapt) from InfluenzaA__ACU80611__HA

SEQ ID NO: 3456 - RNA, 1701 nt, Artificial Sequence; identical to SEQ ID NO: 2782
  derived and/or modified CDS sequence (AUadapt) from InfluenzaA__ACU80622__HA

SEQ ID NO: 3457 - RNA, 1701 nt, Artificial Sequence; identical to SEQ ID NO: 2679
  derived and/or modified CDS sequence (AUadapt) from InfluenzaA__ACU80633__HA

SEQ ID NO: 3458 - RNA, 1701 nt, Artificial Sequence
  derived and/or modified CDS sequence (AUadapt) from InfluenzaA__ACU80644__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacaacucguucuucucccgccugaacuggcucacgcacagcaaguucaaguaccccgcccugaacgugaccaugcccaacaacgaggaguucgacaagcuguacaucuggggcguccaccaccccgggaccgacaacgaccagaucuuccucuacgcgcaggccuccgggcggaucaccgugucgacgaagcgcagccagcagaccgugaucccgaacaucggcucccggccccgcguccggaacauccccucgcgcaucuccaucuacuggaccaucgugaagcccggcgacauccugcugaucaacagcaccgggaaccucaucgccccgcggggcuacuucaagauccgcuccgggaaguccuccaucaugcggucggacgcccccaucggcaagugcaacuccgagugcaucacgcccaacggcagcauccccaacgacaagccguuccagaacgugaaccgcaucaccuacggggccugcccccgguacgucaagcagaacacccugaagcuggcgaccggcaugcgcaacgugcccgagaagcagacgcgggggaucuucggcgccaucgccggguucaucgagaacggcugggagggcaugguggacgggugguacggcuuccgccaccagaacuccgaggggaucggccaggccgccgaccucaagucgacccaggcggccaucgaccagaucaacgggaagcugaaccggcugaucggcaagaccaacgagaaguuccaccagaucgagaaggaguucuccgaggucgagggccgcauccaggaccucgagaaguacguggaggacaccaagaucgaccuguggagcuacaacgccgagcugcucguggcccuggagaaccagcacacgaucgaccugaccgacuccgagaugaacaagcuguucgagaagaccaagaagcagcuccgggagaacgccgaggacauggggaacggcugcuucaagaucuaccacaagugcgacaacgcgugcaucgggucgauccgcaacggcaccuacgaccacgacgucuaccgcgacgaggcccugaacaaccgguuccagaucaaggggguggagcucaaguccggcuacaaggacuggauccuguggaucagcuucgccaucuccugcuuccugcucugcguggcccugcugggcuucaucaugugggccugccagaaggggaacauccgcugcaacaucugcaucuga

SEQ ID NO: 3459 - RNA, 1701 nt, Artificial Sequence; identical to SEQ ID NO: 2679
  derived and/or modified CDS sequence (AUadapt) from InfluenzaA__ACU80655__HA

SEQ ID NO: 3460 - RNA, 1701 nt, Artificial Sequence; identical to SEQ ID NO: 2679
  derived and/or modified CDS sequence (AUadapt) from InfluenzaA__ACU80666__HA

SEQ ID NO: 3461 - RNA, 1701 nt, Artificial Sequence; identical to SEQ ID NO: 2173
  derived and/or modified CDS sequence (AUadapt) from InfluenzaA__ACU80677__HA

SEQ ID NO: 3462 - RNA, 1701 nt, Artificial Sequence; identical to SEQ ID NO: 2679
  derived and/or modified CDS sequence (AUadapt) from InfluenzaA__ACU80688__HA

SEQ ID NO: 3463 - RNA, 1701 nt, Artificial Sequence; identical to SEQ ID NO: 2782
  derived and/or modified CDS sequence (AUadapt) from InfluenzaA__ACU80699__HA

SEQ ID NO: 3464 - RNA, 1701 nt, Artificial Sequence; identical to SEQ ID NO: 2782
  derived and/or modified CDS sequence (AUadapt) from InfluenzaA__ACU80710__HA

SEQ ID NO: 3465 - RNA, 1701 nt, Artificial Sequence
  derived and/or modified CDS sequence (AUadapt) from InfluenzaA__ACU80721__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagacggaggugaccaacgccaccgagcugguccagucguccagcaccggggagaucugcgacucgccccaccagauccucgacggcgagaacugcacgcugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacccuggaguucaacaacgagagcuucaacuggaccggggugacccagaacggcacguccucggccugcauccgccgguccaacaacucguucuucucccgccugaacuggcucacccaccugaaguucaaguaccccgcccugaacgugaccaugcccaacaacgagcaguucgacaagcucuacaucuggggcguccaccaccccgggaccgacaacgaccagaucuuccuguacgcgcaggccagcgggcggaucacgguguccaccaagcgcucgcagcagaccgugaucccgaacaucggcucgcggccccgcguccggaacauccccucccgcaucagcaucuacuggaccaucgugaagcccggcgacauccugcucaucaacuccacggggaaccugaucgccccgcggggcuacuucaagauccgcucggggaaguccagcaucaugcgguccgacgcccccaucggcaagugcaacucggagugcaucacccccaacggcuccauccccaacgacaagccguuccagaacgugaaccgcaucaccuacggggccugcccccgguacgucaagcagaacacccugaagcucgcgacgggcaugcgcaacgugcccgagaagcagacccgggggaucuucggcgccaucgccggguucaucgagaacggcugggagggcaugguggacgggugguacggcuuccgccaccagaacucggaggggcggggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacacgaagaucgaccugugguccuacaacgccgagcuccugguggcccuggagaaccagcacaccaucgaccucaccgacucggagaugaacaagcuguucgagaagaccaagaagcagcugcgcgagaacgccgaggacauggggaacggcugcuucaagaucuaccacaagugcgacaacgcgugcaucggguccauccgcaacggcacguacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 3466 - RNA, 1701 nt, Artificial Sequence; identical to SEQ ID NO: 2679
  derived and/or modified CDS sequence (AUadapt) from InfluenzaA__ACU80732__HA

SEQ ID NO: 3467 - RNA, 1701 nt, Artificial Sequence; identical to SEQ ID NO: 2679
  derived and/or modified CDS sequence (AUadapt) from InfluenzaA__ACU80743__HA

SEQ ID NO: 3468 - RNA, 1701 nt, Artificial Sequence
  derived and/or modified CDS sequence (AUadapt) from InfluenzaA__ACU80754__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacaacucguucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccagcgggcggaucaccguguccacgaagcgcucgcagcagaccgugaucccgaacaucggcagccggccccgcguccggaacauccccucccgcaucucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggcggggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcgugguccugcucggcuucaucaugugggccugccagaaggggaacauccggugcaacaucugcaucuga

SEQ ID NO: 3469 - RNA, 1701 nt, Artificial Sequence
  derived and/or modified CDS sequence (AUadapt) from InfluenzaA__ACU80765__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacaacucguucuucucccgccugaacuggcucacgcacagcaaguucaaguaccccgcccugaacgugaccaugcccaacaacgaggaguucgacaagcuguacaucuggggcguccaccaccccgggaccgacaacgaccagaucuuccucuacgcgcaggccuccgggcggaucaccgugucgacgaagcgcagccagcagaccgugaucccgaacaucggcucccggccccgcguccggaacauccccucgcgcaucuccaucuacuggaccaucgugaagcccggcgacauccugcugaucaacagcaccgggaaccucaucgccccgcggggcuacuucaagauccgcuccgggaaguccuccaucaugcggucggacgcccccaucggcaagugcaacuccgagugcaucacgcccaacggcagcauccccaacgacaagccguuccagaacgugaaccgcaucaccuacggggccugcccccgguacgucaagcagaacacccugaagcuggcgaccggcaugcgcaacgugcccgagaagcagacgcgggggaucuucggcgccaucgccggguucaucgagaacggcugggagggcaugguggacgggugguacggcuuccgccaccagaacuccgaggggaucggccaggccgccgaccucaagucgacccaggcggccaucgaccagaucaacgggaagcugaaccggcugaucggcaagaccaacgagaaguuccaccagaucgagaaggaguucuccgaggucgagggccgcauccaggaccucgagaaguacguggaggacaccaagaucgaccuguggagcuacaacgccgagcugcucguggcccuggagaaccagcacacgaucgaccugaccgacuccgagaugaacaagcuguucgagaagaccaagaagcagcuccgggagaacgccgaggacauggggaacggcugcuucaagaucuaccacaagugcgacaacgcgugcaucgggucgauccgcaacggcaccuacgaccacgacgucuaccgcgacgaggcccugaacaaccgguuccagaucaaggggguggagcucaaguccggcuacaaggacuggauccuguggaucagcuucgccaucuccugcuuccugcucugcaucgcccugcugggcuucaucaugugggccugccagaaggggaacauccgcugcaacaucugcaucuga

SEQ ID NO: 3470 - RNA, 1701 nt, Artificial Sequence
  derived and/or modified CDS sequence (AUadapt) from InfluenzaA__ACU80787__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccucggggcggaucaccguguccacgaagcgcagccagcagaccgugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugauggacgggugguacggcuuccgccaccagaacucggaggggcggggccaggccgccgaccugaaguccacccaggcggccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacacgaucgaccucaccgacucggagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacguguaccgggacgaggcccucaacaaccgcuuccagaucaagggggucgagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 3471 - RNA, 1701 nt, Artificial Sequence; identical to SEQ ID NO: 2679
  derived and/or modified CDS sequence (AUadapt) from InfluenzaA__ACU80798__HA

SEQ ID NO: 3472 - RNA, 1701 nt, Artificial Sequence; identical to SEQ ID NO: 2679
  derived and/or modified CDS sequence (AUadapt) from InfluenzaA__ACU81103__HA

SEQ ID NO: 3473 - RNA, 1701 nt, Artificial Sequence
  derived and/or modified CDS sequence (AUadapt) from InfluenzaA__ACU87270__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccgcgagggccggaugaacuacuacuggacccugaucgagcccggggacaagaucaccuucgaggcgaccggcaaccucguggugccccgcuacgccuucgccauggagcggaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagucgaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgugaucgagaagaugaacacccaguucacggccgucggcaaggaguucaaccaccuggagaagcggaucgagaaccugaacaagaagguggacgacggcuuccucgacaucuggaccuacaacgccgagcugcugguccuccuggagaacgagcgcacccuggacuaccacgacagcaacgugaagaaccucuacgagaaggugcggucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgcgaggagaucgacggcgugaagcucgagagcacccggaucuaccagauccuggcgaucuacuccaccguggccucgagccugguccucguggugucccugggggccaucucguucuggaugugcuccaacggcagccugcagugccgcaucugcaucuga

SEQ ID NO: 3474 - RNA, 1701 nt, Artificial Sequence; identical to SEQ ID NO: 116
  derived and/or modified CDS sequence (AUadapt) from InfluenzaA__ACV04228__HA

SEQ ID NO: 3475 - RNA, 1701 nt, Artificial Sequence; identical to SEQ ID NO: 116
  derived and/or modified CDS sequence (AUadapt) from InfluenzaA__ACV04238__HA

SEQ ID NO: 3476 - RNA, 1701 nt, Artificial Sequence
  derived and/or modified CDS sequence (AUadapt) from InfluenzaA__ACV04248__HA
auggaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaaggggaucaccgccgccugcccgcacgccggcgcgaaguccuucuacaagaaccugaucuggcucgucaagaaggggaacagcuaccccaagcuguccaagucguacaucaacgacaagggcaaggaggugcuggugcucugggggauccaccaccccagcaccuccgccgaccagcagucgcuguaccagaacgccgacgccuacgucuucgugggcuccagccgguacuccaagaaguucaagcccgagaucgccauccgcccgaaggugcgggaccaggagggccgcaugaacuacuacuggacgcuggucgagcccggggacaagaucaccuucgaggcgaccggcaaccucguggugccccgguacgccuucgccauggagcgcaacgccgggucgggcaucaucaucuccgacacccccguccacgacugcaacacgaccugccagaccccgaagggcgccaucaacaccagccugcccuuccacaacauccaccccaucacgaucgggaagugccccaaguacgugaaguccaccaagcugcggcucgcgaccggccugcgcaacgugccgucgauccagucccgggggcuguucggcgccaucgccggguucaucgagggcggcuggaccgggauggucgacggcugguacggguaccaccaccagaacgagcagggcagcggguacgccgccgaccucaaguccacgcagaacgcgaucgacgagaucaccaacaaggugaacucggugaucgagaagaugaacacccaguucaccgccgucggcaaggaguucaaccaccuggagaagcgcaucgagaaccugaacaagaagguggacgacggcuuccucgacaucuggacguacaacgccgagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuaccccaaguacucggaggaggccaagcugaaccgggaggagaucgacggcgugaagcucgaguccacccgcaucuaccagauccuggcgaucuacagcaccguggccucgucccugguccucguggugagccugggggccaucuccuucuggaugugcagcaacggcucccugcagugccggaucugcaucuga

SEQ ID NO: 3477 - RNA, 1701 nt, Artificial Sequence; identical to SEQ ID NO: 116
  derived and/or modified CDS sequence (AUadapt) from InfluenzaA__ACV04258__HA

SEQ ID NO: 3478 - RNA, 1701 nt, Artificial Sequence; identical to SEQ ID NO: 116
  derived and/or modified CDS sequence (AUadapt) from InfluenzaA__ACV04268__HA

SEQ ID NO: 3479 - RNA, 1701 nt, Artificial Sequence; identical to SEQ ID NO: 116
  derived and/or modified CDS sequence (AUadapt) from InfluenzaA__ACV04278__HA

SEQ ID NO: 3480 - RNA, 1701 nt, Artificial Sequence; identical to SEQ ID NO: 116
  derived and/or modified CDS sequence (AUadapt) from InfluenzaA__ACV04288__HA

SEQ ID NO: 3481 - RNA, 1701 nt, Artificial Sequence
  derived and/or modified CDS sequence (AUadapt) from InfluenzaA__ACV04298__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccgugaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggucaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgucaagcucgagagcacccgcaucuaccagauccuggcgaucuacuccaccguggccucgagccuggugcucgucgugucccugggggccaucucguucuggaugugcuccaacggcagccugcagugccggaucugcaucuga

SEQ ID NO: 3482 - RNA, 1701 nt, Artificial Sequence; identical to SEQ ID NO: 116
  derived and/or modified CDS sequence (AUadapt) from InfluenzaA__ACV04308__HA

SEQ ID NO: 3483 - RNA, 1701 nt, Artificial Sequence
  derived and/or modified CDS sequence (AUadapt) from InfluenzaA__ACV04318__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacaacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 3484 - RNA, 1701 nt, Artificial Sequence; identical to SEQ ID NO: 116
  derived and/or modified CDS sequence (AUadapt) from InfluenzaA__ACV04328__HA

SEQ ID NO: 3485 - RNA, 1701 nt, Artificial Sequence; identical to SEQ ID NO: 116
  derived and/or modified CDS sequence (AUadapt) from InfluenzaA__ACV04338__HA

SEQ ID NO: 3486 - RNA, 1701 nt, Artificial Sequence; identical to SEQ ID NO: 3156
  derived and/or modified CDS sequence (AUadapt) from InfluenzaA__ACV04358__HA

SEQ ID NO: 3487 - RNA, 1701 nt, Artificial Sequence
  derived and/or modified CDS sequence (AUadapt) from InfluenzaA__ACV04368__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugccagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 3488 - RNA, 1701 nt, Artificial Sequence
  derived and/or modified CDS sequence (AUadapt) from InfluenzaA__ACV04378__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacaucccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgagccugguccucaucgugucccugggggccaucucguucuggaugugcuccaacggcagccugcagugccggaucugcaucuga

SEQ ID NO: 3489 - RNA, 1701 nt, Artificial Sequence; identical to SEQ ID NO: 3156
  derived and/or modified CDS sequence (AUadapt) from InfluenzaA__ACV04388__HA

SEQ ID NO: 3490 - RNA, 1701 nt, Artificial Sequence; identical to SEQ ID NO: 116
  derived and/or modified CDS sequence (AUadapt) from InfluenzaA__ACV04398__HA

SEQ ID NO: 3491 - RNA, 1701 nt, Artificial Sequence; identical to SEQ ID NO: 3158
  derived and/or modified CDS sequence (AUadapt) from InfluenzaA__ACV04408__HA

SEQ ID NO: 3492 - RNA, 1701 nt, Artificial Sequence; identical to SEQ ID NO: 116
  derived and/or modified CDS sequence (AUadapt) from InfluenzaA__ACV04489__HA

SEQ ID NO: 3493 - RNA, 1701 nt, Artificial Sequence; identical to SEQ ID NO: 116
  derived and/or modified CDS sequence (AUadapt) from InfluenzaA__ACV04499__HA

SEQ ID NO: 3494 - RNA, 1701 nt, Artificial Sequence; identical to SEQ ID NO: 96
  derived and/or modified CDS sequence (AUadapt) from InfluenzaA__ACV04509__HA

SEQ ID NO: 3495 - RNA, 1701 nt, Artificial Sequence; identical to SEQ ID NO: 116
  derived and/or modified CDS sequence (AUadapt) from InfluenzaA__ACV04519__HA

SEQ ID NO: 3496 - RNA, 1701 nt, Artificial Sequence; identical to SEQ ID NO: 116
  derived and/or modified CDS sequence (AUadapt) from InfluenzaA__ACV04529__HA

SEQ ID NO: 3497 - RNA, 1701 nt, Artificial Sequence; identical to SEQ ID NO: 116
  derived and/or modified CDS sequence (AUadapt) from InfluenzaA__ACV04549__HA

SEQ ID NO: 3498 - RNA, 1701 nt, Artificial Sequence; identical to SEQ ID NO: 116
  derived and/or modified CDS sequence (AUadapt) from InfluenzaA__ACV04559__HA

SEQ ID NO: 3499 - RNA, 1701 nt, Artificial Sequence; identical to SEQ ID NO: 116
  derived and/or modified CDS sequence (AUadapt) from InfluenzaA__ACV04579__HA

SEQ ID NO: 3500 - RNA, 1701 nt, Artificial Sequence
  derived and/or modified CDS sequence (AUadapt) from InfluenzaA__ACV04751__HA
auggaggccauccugguggucaugcucuacaccuucgccaccgcgaacgccgacacgcugugcaucggcuaccacgccaacaacucgaccgacaccguggacaccgugcuggagaagaacgucacggugacccacuccgugaaccuccuggaggacaagcacaacgggaagcugugcaagcuccgcggcgucgcgccccugcggcuggggaagugcaacaucgccggcuggauccucgggaacccggagugcgagucgcuguccaccgccagcuccuggucguacaucguggagaccuccagcuccgacaacggcacgugcuaccccggcgacuucaucgacuacgaggagcugcgcgagcagcucucguccgugagcuccuucgagcgguucgagaucuuccccaagaccucguccuggcccaaccacgacagcaacaagggggucaccgccgccugcccgcacgccggcgcgaaguccuucuacaagaaccugaucuggcuggugaagaaggggaacucguaccccaagcucuccaagagcuacaucaacgacaagggcaaggaggugcugguccugugggggauccaccaccccucgaccuccgccgaccagcagagccucuaccagaacgccgacgccuacguguucgugggcacgucccgcuacucgaagaaguucaagcccgagaucgccauccggccgaagguccgcgaccaggagggccggaugaacuacuacuggacccugguggagcccggggacaagaucaccuucgaggcgaccggcaaccugguggucccccgcuacgccuucgccauggagcggaacgccggguccggcaucaucaucagcgacacgcccgugcacaacugcaacacgaccugccagaccccgaagggcgccaucaacaccucccuccccuuccagaacauccaccccaucaccaucgggaagugccccaaguacgucaagucgaccaagcugcgccuggcgaccggccuccggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccuggacaucuggaccuacaacgccgagcuccuggugcugcucgagaacgagcgcacccuggacuaccacgacagcaacgugaagaaccuguacgagaagguccggucccagcucaagaacaacaccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcuggagagcacccggaucuaccagauccucgccaucuacuccaccgucgcgucgagccuggugcugguggucucccucggggccaucucguucuggaugugcuccaacggcagccugcagugccgcaucugcaucuga

SEQ ID NO: 3501 - RNA, 1701 nt, Artificial Sequence
  derived and/or modified CDS sequence (AUadapt) from InfluenzaA__ACV04752__HA
auggaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgagaacccggagugcgagagccuguccaccgccucguccuggagcuacaucguggagaccuccucguccgacaacgggacgugcuaccccggcgacuucaucgacuacgaggagcugcgggagcagcucagcuccgugucguccuucgagcgcuucgagaucuuccccaagaccagcuccuggcccaaccacgacucgaacaagggcgucaccgccgccugcccgcacgccggggcgaaguccuucuacaagaaccugaucuggcuggugaagaagggcaacagcuaccccaagcucuccaagucguacaucaacgacaaggggaaggaggugcugguccuguggggcauccaccaccccagcaccuccgccgaccagcagucgcucuaccagaacgccgacgccuacguguucgugggguccagccgguacuccaagaaguucaagcccgagaucgccauccgcccgaagguccgggaccaggagggccgcaugaacuacuacuggacgcugguggagcccggcgacaagaucaccuucgaggcgaccgggaaccugguggucccccgguacgccuucgccauggagcgcaacgccggcucggggaucaucaucuccgacacccccgugcacgacugcaacacgaccugccagaccccgaagggcgccaucaacaccagccuccccuuccacaacauccaccccaucacgaucggcaagugccccaaguacgugaaguccaccaagcugcggcuggcgaccgggcuccgcaacgucccgucgauccagucccggggccuguucggggccaucgccggcuucaucgagggcggguggaccggcaugguggacgggugguacggcuaccaccaccagaacgagcaggggagcggcuacgccgccgaccugaaguccacgcagaacgcgaucgacgagaucaccaacaaggugaacucggucaucgagaagaugaacacccaguucaccgccguggggaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcagccagcucaagaacaacgccaaggagaucggcaacgggugcuucgaguucuaccacaagugcgacaacacgugcauggaguccgugaagaacggcaccuacgacuaccccaaguacucggaggaggccaagcugaaccgggaggagaucgacggggugaagcuggaguccacccgcaucuaccagauccucgcgaucuacagcaccgucgccucgucccuggugcugguggucagccucggcgccaucuccuucuggaugugcagcaacgggucccugcagugccggaucugcaucuga

SEQ ID NO: 3502 - RNA, 1701 nt, Artificial Sequence
  derived and/or modified CDS sequence (AUadapt) from InfluenzaA__ACV04753__HA
auggaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccgcgagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggcgaucuacuccaccgucgccucgagccuggugcucguggucucccugggggccaucucguucuggaugugcuccaacggcagccugcagugccgcaucugcaucuga

SEQ ID NO: 3503 - RNA, 1701 nt, Artificial Sequence
  derived and/or modified CDS sequence (AUadapt) from InfluenzaA__ACV04754__HA
auggaggccauccuggugguccuccuguacaccuucgccaccgcgaacgccgacacgcugugcaucggcuaccacgccaacaacucgaccgacaccguggacaccgugcucgagaagaacguccccgugacgcacuccgugaaccugcugaaggacaagcacaacgggaagcucugcaagcugcgcggcgucgccccgcugcaccucgggaagugcaacaucgccggcuggauccuggggaaccccgagugcgagucgcuguccaccgcgagcuccuggucguacaucguggagaccuccagcuccgacaacgggaccugcuaccccggcgacuucaucgacuacgaggagcuccgggagcagcugucguccgugagcuccuucgagcgcuucgagaucuuccccaagacgucguccuggccgaaccacgagagcaacaagggggucaccgccgccugcccccacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcaccucccgguacucgaagaaguucaagccggagaucgccauccgccccaagguccgggaccaggagggccgcaugaacuacuacuggacgcugguggagcccggggacaagaucaccuucgaggcgaccggcaaccucguggucccccgguacgccuucgccauggagcgcaacgccggguccggcaucaucaucagcgacaccccggugcacgacugcaacacgaccugccagacccccaagggcgccaucaacaccucccugcccuuccagaacauccaccccaucacgaucgggaagugcccgaaguacgucaagucgaccaagcugcggcucgcgaccggccugcgcaacgugcccuccauccagagccggggcguguucggcgccaucgccggguucaucgagggcggcuggaccgggaugguggacggcugguacggguaccaccaccagaacgagcagggcuccggguacgccgccgaccucaagucgacgcagaacgcgaucgacgagaucaccaacaaggucaacuccgugaucgagaagaugaacacccaguucaccgccgucggcaaggaguucaaccaccuggagaagcgcaucgagaaccugaacaagaagguggacgacggcuuccuggacaucuggacguacaacgccgagcuccuggugcugcucgagaacgagcggacccuggacuaccacgacagcaacgucaagaaccuguacgagaaggugcgcucccagcucaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgucaagcuggagagcacccgcaucuaccagauccucgcgaucuacuccaccguggccucgagccuggugcuggucgugucccucggggccaucucguucuggaugugcuccaacggcagccugcagugccggaucugcaucuga

SEQ ID NO: 3504 - RNA, 1701 nt, Artificial Sequence; identical to SEQ ID NO: 3399
  derived and/or modified CDS sequence (AUadapt) from InfluenzaA__ACV04755__HA

SEQ ID NO: 3505 - RNA, 1701 nt, Artificial Sequence; identical to SEQ ID NO: 96
  derived and/or modified CDS sequence (AUadapt) from InfluenzaA__ACV33084__HA

SEQ ID NO: 3506 - RNA, 1701 nt, Artificial Sequence; identical to SEQ ID NO: 116
  derived and/or modified CDS sequence (AUadapt) from InfluenzaA__ACV33094__HA

SEQ ID NO: 3507 - RNA, 1701 nt, Artificial Sequence; identical to SEQ ID NO: 116
  derived and/or modified CDS sequence (AUadapt) from InfluenzaA__ACV33104__HA

SEQ ID NO: 3508 - RNA, 1701 nt, Artificial Sequence; identical to SEQ ID NO: 116
  derived and/or modified CDS sequence (AUadapt) from InfluenzaA__ACV33114__HA

SEQ ID NO: 3509 - RNA, 1701 nt, Artificial Sequence; identical to SEQ ID NO: 116
  derived and/or modified CDS sequence (AUadapt) from InfluenzaA__ACV33124__HA

SEQ ID NO: 3510 - RNA, 1701 nt, Artificial Sequence; identical to SEQ ID NO: 116
  derived and/or modified CDS sequence (AUadapt) from InfluenzaA__ACV33134__HA

SEQ ID NO: 3511 - RNA, 1701 nt, Artificial Sequence; identical to SEQ ID NO: 3476
  derived and/or modified CDS sequence (AUadapt) from InfluenzaA__ACV33144__HA

SEQ ID NO: 3512 - RNA, 1701 nt, Artificial Sequence; identical to SEQ ID NO: 116
  derived and/or modified CDS sequence (AUadapt) from InfluenzaA__ACV33154__HA

SEQ ID NO: 3513 - RNA, 1701 nt, Artificial Sequence; identical to SEQ ID NO: 116
  derived and/or modified CDS sequence (AUadapt) from InfluenzaA__ACV33164__HA

SEQ ID NO: 3514 - RNA, 1701 nt, Artificial Sequence; identical to SEQ ID NO: 116
  derived and/or modified CDS sequence (AUadapt) from InfluenzaA__ACV33174__HA

SEQ ID NO: 3515 - RNA, 1701 nt, Artificial Sequence; identical to SEQ ID NO: 62
  derived and/or modified CDS sequence (AUadapt) from InfluenzaA__ACV41981__HA

SEQ ID NO: 3516 - RNA, 1701 nt, Artificial Sequence; identical to SEQ ID NO: 2940
  derived and/or modified CDS sequence (AUadapt) from InfluenzaA__ACV41991__HA

SEQ ID NO: 3517 - RNA, 1701 nt, Artificial Sequence; identical to SEQ ID NO: 2940
  derived and/or modified CDS sequence (AUadapt) from InfluenzaA__ACV42001__HA

SEQ ID NO: 3518 - RNA, 1701 nt, Artificial Sequence; identical to SEQ ID NO: 116
  derived and/or modified CDS sequence (AUadapt) from InfluenzaA__ACV42008__HA

SEQ ID NO: 3519 - RNA, 1701 nt, Artificial Sequence; identical to SEQ ID NO: 116
  derived and/or modified CDS sequence (AUadapt) from InfluenzaA__ACV42018__HA

SEQ ID NO: 3520 - RNA, 1701 nt, Artificial Sequence; identical to SEQ ID NO: 2561
  derived and/or modified CDS sequence (AUadapt) from InfluenzaA__ACV49501__HA

SEQ ID NO: 3521 - RNA, 1701 nt, Artificial Sequence
  derived and/or modified CDS sequence (AUadapt) from InfluenzaA__ACV49512__HA
augaagaccaucaucgcccugucguacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagucguccagcaccggcaagaucugcaacaacccccaccgcauccuggacgggaucgacugcacccugaucgacgcccuccugggcgacccccacugcgacgucuuccagaacgagacgugggaccuguucguggagcgguccaaggccuucucgaacugcuaccccuacgacgugccggacuacgcgucccuccgcagccuggucgccuccucgggcacccuggaguucaucaccgagggguucaccuggacgggcgugacccagaacgggggcuccaacgccugcaagcgggggcccggcagcggcuucuucucccgccucaacuggcugaccaagucgggguccaccuaccccgugcugaacgucacgaugcccaacaacgacaacuucgacaagcucuacaucuggggcgugcaccacccgagcaccaaccaggagcagaccucccuguacgugcaggccucggggcgggucaccguguccacgcgccggagccagcagaccaucauccccaacaucgagucgcgccccugggugcggggccuguccagccgcaucuccaucuacuggaccaucgucaagcccggcgacgugcucgugaucaacucgaacgggaaccugaucgcgccgcggggcuacuucaagaugcgcaccgggaaguccagcaucaugcgguccgacgcccccaucgacacgugcaucucggagugcaucacccccaacggcuccauccccaacgacaagccguuccagaacgucaacaagaucaccuacggggccugccccaaguacgugaagcagaacacccugaagcucgccacgggcaugcgcaacgugcccgagaagcagacccggggccuguucggggccaucgcgggcuucaucgagaacgggugggagggcaugaucgacgggugguacggcuuccgccaccagaacagcgagggcaccgggcaggccgccgaccugaaguccacccaggccgccaucgaccagaucaacggcaagcucaaccgggucaucgagaagacgaacgagaaguuccaccagaucgagaaggaguucucggagguggaggggcgcauccaggaccuggagaaguacguggaggacaccaagaucgaccugugguccuacaacgcggagcuccuggucgcccuggagaaccagcacaccaucgaccucaccgacagcgagaugaacaagcuguucgagaagacgcggcgccagcugcgggagaacgccgaggacaugggcaacgggugcuucaagaucuaccacaagugcgacaacgccugcaucgaguccauccgcaacggcaccuacgaccacgacguguaccgcgacgaggcccucaacaaccgguuccagaucaaggacgucgagcucaagucgggcuacaaggacuggauccuguggaucuccuucgcgaucagcugcuuccugcugugcguggugcugcucggguucaucaugugggccugccagcgcggcaacauccggugcaacaucugcaucuga

SEQ ID NO: 3522 - RNA, 1701 nt, Artificial Sequence; identical to SEQ ID NO: 141
  derived and/or modified CDS sequence (AUadapt) from InfluenzaA__ACV49523__HA

SEQ ID NO: 3523 - RNA, 1698 nt, Artificial Sequence
  derived and/or modified CDS sequence (AUadapt) from InfluenzaA__ACV49545__HA
augaaggccaaccugcucgugcugcugugcgcccucgcggccgccgacgccgacaccaucugcaucggcuaccacgccaacaacucgaccgacacggucgacaccgugcuggagaagaacgugaccgucacccacuccgugaaccugcucgaggacagccacaacgggaagcugugccgccugaagggcaucgcgccccuccagcuggggaagugcaacaucgccggcuggcugcucgggaacccggagugcgacccccugcugcccgugcgguccuggucguacaucgucgagacgcccaacuccgagaacggcaucugcuacccgggcgacuucaucgacuacgaggagcuccgcgagcagcugagcuccgugucguccuucgagcgguucgagaucuuccccaaggagagcuccuggcccaaccacaacaccaacggggugaccgccgccugcucgcacgagggcaaguccagcuucuaccgcaaccugcucuggcugaccgagaaggagggguccuaccccaagcugaagaacucguacgucaacaagaagggcaaggaggugcucgugcugugggggauccaccacccgcccaacuccaaggagcagcagaaccuguaccagaacgagaacgcguacgucagcguggugacguccaacuacaaccggcgcuucacccccgagaucgccgagcggcccaagguccgcgaccaggccggccggaugaacuacuacuggacccuccugaagccgggcgacaccaucaucuucgaggccaacgggaaccugaucgcccccauguacgcguucgcccucucgcgcggcuucgggagcggcaucaucacguccaacgccucgaugcacgagugcaacaccaagugccagacgccccugggcgccaucaacuccagccugcccuaccagaacauccacccggugaccaucggggagugccccaaguacgugcgguccgccaagcuccgcauggucaccggccugcggaacauccccucgauccagucccgcgggcuguucggcgcgaucgccggguucaucgagggcggcuggaccgggaugaucgacggcugguacggguaccaccaccagaacgagcagggcagcggguacgccgccgaccagaaguccacccagaacgccaucaacggcaucaccaacaaggugaacacggugaucgagaagaugaacauccaguucaccgcggucggcaaggaguucaacaagcucgagaagcggauggagaaccugaacaagaagguggacgacggguuccuggacaucuggaccuacaacgccgagcuccuggugcugcucgagaacgagcgcacccuggacuuccacgacucgaacgucaagaaccuguacgagaaggugaagucccagcucaagaacaacgccaaggagaucggcaacgggugcuucgaguucuaccacaagugcgacaacgagugcauggagagcguccggaacggcacguacgacuaccccaaguacuccgaggagucgaagcugaaccgcgagaagguggacggggugaagcuggaguccaugggcaucuaccagauccucgccaucuacagcaccgucgccuccucgcuggugcugcucgugucccugggcgcgaucagcuucuggaugugcagcaacgggucccugcagugccggaucugcaucuga

SEQ ID NO: 3524 - RNA, 1701 nt, Artificial Sequence
  derived and/or modified CDS sequence (AUadapt) from InfluenzaA__ACV49556__HA
augaaggcccgccugcucauccugcugugcgcccucgcggccaccgacgccgacaccaucugcaucggcuaccacgccaacaacucgacggacaccguggacaccguccuggagaagaacgugaccgugacgcacuccgucaaccugcucgaggacagccacaacgggaagcugugccggcugaagggcaucgcgccccuccagcuggggaagugcaacaucgccggcuggauccuggggaacccggagugcgacucccuccugcccgccagcuccuggucguacaucguggagacccccaacuccaagaacggcaucugcuaccccggcgacuucaucgacuacgaggagcugcgcgagcagcucagcuccgugagcuccuucgagcgguucgagaucuucccgaaggagucguccuggcccaagcacagcaccaccaagggggucacggccgccugcucccacgcgggcaagagcuccuucuaccgcaaccugcuguggcucaccaagaaggaggacagcuaccccaagcuguccaacucguacgugaacaagaaggggaaggaggugcugguccucuggggcgugcaccaccccagcuccagcaaggagcagcagacccuguaccagaacgagaacgccuacguguccgucgugucguccaacuacaaccggcgcuucaucccggagaucgccgagcggcccgaggugaaggaccaggccgggcgcaucaacuacuacuggacccugcucgagcccggcgacacgaucaucuucgaggccaacggcaaccuggucgcgcccugguacgccuucgcccugagccggggguucggcuccgggaucaucaccagcaacgccuccaugcacgagugcaacaccaagugccagaccccgcagggcgccaucaacucgucccuccccuuccagaacauccaccccgugacgaucggcgagugccccaaguacgucaagagcgcgaagcugcgcauggugaccgggcugcggaacaucccguccauccagagccgcggccucuucggggccaucgccggcuucaucgagggcggguggaccggcaugaucgacgggugguacggcuaccaccaccagaacgagcagggguccggcuacgccgccgaccagaaguccacccagaacgcgaucaacgggaucacgaacaaggugaacagcgugaucgagaagaugaacacccaguucaccgccgucggcaaggaguucaacaaccuggagaagcggauggagaaccugaacaagaagguggacgacggcuuccucgacaucuggaccuacaacgccgagcugcuggugcuccuggagaacgagcgcacgcuggacuuccacgacucgaacgucaagaaccucuacgagaaggugaagauccagcugaagaacaacgccaaggagaucgggaacggcugcuucgaguucuaccacaagugcgacaacgagugcauggaguccguccggaacgggaccuacgacuaccccaaguacagcaaggagagcaagcugaaccgcgagaagaucgacggcgugaagcucgaguccauggggguguaccagauccuggccaucuacucgaccgucgcguccagccuggugcuccuggugucccugggcgccaucagcuucuggaugugcuccaacggcagccuccagugccggaucugcaucuga

SEQ ID NO: 3525 - RNA, 1701 nt, Artificial Sequence
  derived and/or modified CDS sequence (AUadapt) from InfluenzaA__ACV49567__HA
augaaggccaagcugcucauccugcugugcgcccucaccgcgaccgacgccgacacgaucugcaucggcuaccacgccaacaacucgaccgacaccguggacaccguccuggagaagaacgugacggugacccacuccgucaaccugcucgaggacagccacaacgggaagcugugccgccugaagggcaucgcgccccuccagcuggggaagugcaacaucgccggcuggauccuggggaacccggagugcgagucccuccugucgaagcgguccuggagcuacaucgccgagacccccaacuccgagaacggcgccugcuaccccggcgacuucgccgacuacgaggagcugcgcgagcagcucucguccgugagcuccuucgagcgguucgagaucuuccccaaggagcgcucguggccgaagcacaacaucacccgcggggugacggccgcgugcucccacgccggcaagagcuccuucuacaagaaccugcuguggcucaccgagaccgacgggucguaccccaagcuguccaagagcuacgucaacaacaaggagaaggaggugcuggugcucuggggcguccaccaccccuccaacaucgaggaccagaagacccuguaccggaaggagaacgccuacgugucgguggucagcuccaacuacaaccggcgcuucacgcccgagaucgccgagcggccgaaggugcgcgggcaggccggccggaucaacuacuacuggacccugcucgagcccggcgacaccaucaucuucgaggcgaacgggaaccugaucgcccccugguacgccuucgcccugucgcgcgacuucggcuccgggaucaucaccagcaacgccuccauggacgagugcgacacgaagugccagacgccccagggcgcgaucaacucgucccucccguuccagaacauccaccccgugaccaucggcgagugccccaaguacgucaagagcaccaagcugcggauggugaccgggcugcgcaacauccccuccauccagucgcggggccucuucggggccaucgccggcuucaucgagggcggguggaccggcaugaucgacgggugguacggcuaccaccaccagaacgagcagggguccggcuacgccgccgaccagaaguccacccagaacgcgaucaacuggaucaccaacaaggugaacagcgucaucgagaagaugaacacgcaguucaccgccguggggaaggaguucaacaagcuggagaagcgcauggagaaccugaacaagaagguggacgacggcuuccucgacaucuggaccuacaacgccgagcugcugguccuccuggagaacgagcggacccuggacuuccacgacucgaacgugaagaaccucuacgagaaggugaagaaccagcugcgcaacaacgccaaggagaucggcaacgggugcuucgaguucuaccacaagugcaacaacgagugcauggaguccgucaagaacggcacguacgacuacccgaaguacagcgaggaguccaagcugaaccgggagaagaucgacggggugaagcucgagucgaugggcgucuaccagauccuggccaucuacuccaccguggcgagcucgcuggugcuccuggucucccugggggccaucagcuucuggaugugcuccaacggcagccuccagugccgcaucugcaucuga

SEQ ID NO: 3526 - RNA, 1689 nt, Artificial Sequence
  derived and/or modified CDS sequence (AUadapt) from InfluenzaA__ACV49578__HA
auggccaucaucuaccugauccuccuguucaccgccgugcgcggcgaccagaucugcaucggguaccacgcgaacaacucgaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugcggguccccgaguggucguacaucauggagaaggagaaccccaaguacucccucugcuacccgggcagcuucaacgacuacgaggagcugaagcaccuccuguccucggugaagcacuucgagaaggugaagauccugcccaaggaccgcuggacgcagcacaccaccaccgggggcucccgggccugcgccgucagcgggaaccccuccuucuuccgcaacaugguguggcugacgaagaagggccccaacuacccgguggcgaaggggucguacaacaacaccuccggcgagcagaugcucaucaucuggggcguccaccaccccaucgacgaggccgagcagaucgcccuguaccagaagguggggaccuacgugucggccuccaccagcacgcugaacaagcgguccacccccgagaucgcggcccgccccgaggucaacggccucgggucgcggauggaguucuccuggacccugcuggacaugugggacaccaucaacuucgagagcacgggcaaccucguggccccggaguacggcuucaagaucuccaagcgcgggucgucgggcaucaugaagaccgaggggacccuggagaacugcgagaccaagugccagacgccccugggcgccaucaacaccacccuccccuuccacaacgugcacccccugaccaucggggagugcccgaaguacgucaaguccgagaagcuggugcucgccacgggccugcggaacgugccccagaucgagagccgcggccuguucggggcgaucgccggcuucaucgagggcggguggcaggggauggucgacggcugguacggcuaccaccacuccaacgaccaggggucgggcuacgccgccgacaaggaguccacccagaaggccuucgacgggaucaccaacaaggugaacagcgugaucgagaagaugaacacccaguucgaggcggucggcaaggaguucuccaaccucgagaagcggcuggagaaccugaacaagaagauggaggacggguuccucgacguguggacguacaacgccgagcugcuggugcucauggagaacgagcgcacccuggacuuccacgacucgaacgucaagaaccuguacgacaaggugcggaugcagcuccgcgacaacgucaaggagcugggcaacggcugcuucgaguucuaccacaagugcgacgacgagugcauggacuccgugaagaacgggaccuacgacuaccccaaguacgaggaggagucgaagcugaaccggaacgagaucaagggcgugaagcucuccagcaugggggucuaccagauccuggccaucuacgccaccguggccggcucccugucgcucgcgaucaugauggccggcaucuccuucuggaugugcagcaacgggucccugcagugccgcaucugcaucuga

SEQ ID NO: 3527 - RNA, 1689 nt, Artificial Sequence; identical to SEQ ID NO: 3526
  derived and/or modified CDS sequence (AUadapt) from InfluenzaA__ACV49589__HA

SEQ ID NO: 3528 - RNA, 1689 nt, Artificial Sequence; identical to SEQ ID NO: 140
  derived and/or modified CDS sequence (AUadapt) from InfluenzaA__ACV49600__HA

SEQ ID NO: 3529 - RNA, 1689 nt, Artificial Sequence
  derived and/or modified CDS sequence (AUadapt) from InfluenzaA__ACV49611__HA
auggccaucaucuaccugauccuccuguucaccgccgugcgcggcgaccagaucugcaucggguaccacgcgaacaacucgaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugucgguccccgagugguccuacaucauggagaaggagaacccccgggacggccucugcuacccggggucguucaacgacuacgaggagcugaagcaccuccuguccucggugaagcacuucgagaaggugaagauccugcccaaggaccgcuggacgcagcacaccaccaccggcgggucccgggccugcgccgucagcggcaaccccuccuucuuccgcaacaugguguggcugacggagaaggggucgaacuaccccguggcgaagggcuccuacaacaacaccucgggcgagcagaugcucaucaucuggggcguccaccacccgaacgacgagaccgagcagcggacccuguaccagaacguggggacguacguguccgucgggaccucgacccugaacaagcgcuccacccccaagaucgccacgcggcccaaggugaacggccagggcgggcgcauggaguucucguggacccuccuggacaugugggacaccaucaacuucgaguccaccggcaaccugaucgcccccgaguacggguucaagaucagcaagcggggcuccucggggaucaugaagacggagggcacccucgagaacugcgagaccaagugccagaccccgcugggcgccaucaacacgacccugcccuuccacaacgugcacccccucaccaucggggagugccccaaguacgucaagucggagaagcuggugcuggcgaccggccuccgcaacgugccgcagaucgagucccgggggcuguucggcgccaucgccggguucaucgagggcggcuggcaggggauggucgacggcugguacggguaccaccacucgaacgaccagggcuccggguacgccgccgacaaggagucgacgcagaaggcguucgacggcaucaccaacaaggugaacuccgugaucgagaagaugaacacccaguucgaggccgucggcaaggaguucagcaaccuggagcgccggcucgagaaccugaacaagaagguggaggacggguuccuggacguguggaccuacaacgccgagcuccugguccugauggagaacgagcgcacgcucgacuuccacgacuccaacgugaagaaccuguacgacaagguccggaugcagcugcgcgacaacgugaaggagcucggcaacgggugcuucgaguucuaccacaagugcgacgacgagugcaugaacucggugaagaacggcaccuacgacuaccccaaguacgaggaggaguccaagcugaaccggaacgagaucaagggcgucaagcugucguccauggggguguaccagauccucgccaucuacgccaccguggcgggcucgcugucccuggccaucaugauggccgggaucucguucuggaugugcuccaacggcagccuccagugccgcaucugcaucuga

SEQ ID NO: 3530 - RNA, 1701 nt, Artificial Sequence
  derived and/or modified CDS sequence (AUadapt) from InfluenzaA__ACV49633__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcucgaaggccuacuccaacugcuaccccuacgacgugccggacuacgcgagccuccggucccuggucgccucguccggcacgcuggaguucaccaacgagggguucaacuggaccggcguggcccaggacgggaccagcuacgccugcaagcgcggcuccgugaaguccuucuucucccggcucaacuggcugcacaagcuggaguacaaguaccccgcgcucaacgucacgaugcccaacaacgacaaguucgacaagcuguacaucuggggcgugcaccaccccucgaccgacuccgugcagaccagccuguacguccaggccuccgggcgcgugaccgugagcacgaagcggucgcagcagaccgucaucccgaacaucggcucccgccccugggugcgggggaucagcucccgcaucucgaucuacuggaccaucgugaagcccggcgacauccuccugaucaacuccaccgggaaccugaucgcgccccggggcuacuucaagauccgcagcggcaaguccucgaucaugcgguccgacgccccgaucgggaacugcaacagcgagugcaucacgcccaacggcuccauccccaacgacaagcccuuccagaacgucaaccgcaucaccuacggggccugcccgcgguacgugaagcagaacacccucaagcuggccaccggcaugcgcaacgugcccgagaagcagacgcgggggaucuucggcgccaucgccggcuucaucgagaacgggugggagggcauggucgacgggugguacggcuuccgccaccagaacucggaggggaccggccaggccgccgaccugaaguccacccaggcggccaucaaccagaucaacggcaagcucaaccggcugaucgagaagaccaacgagaaguucccccagaucgagaaggaguucagcgagguggaggggcgcauccaggaccuggagaaguacguggaggacacgaagaucgaccucugguccuacaacgccgagcugcuggucgcccucgagaaccagcacaccaucgaccugaccgacucggagaugaacaagcuguucgagcggacccgcaagcagcuccgcgagaacgccgaggacaugggcaacgggugcuucaagaucuaccacaagugcgacaacgcgugcaucggcuccauccggaacgggacguacgaccacgacguguaccgcgacgaggcccugaacaaccgguuccagaucaagggcgucgagcucaagagcggcuacaaggacuggauccuguggaucuccuucgccaucagcugcuuccugcugugcguggugcuccugggguucaucaugugggccugccagaagggcaacauccgcugcaacaucugcaucuga

SEQ ID NO: 3531 - RNA, 1701 nt, Artificial Sequence; identical to SEQ ID NO: 2601
  derived and/or modified CDS sequence (AUadapt) from InfluenzaA__ACV49644__HA

SEQ ID NO: 3532 - RNA, 1698 nt, Artificial Sequence; identical to SEQ ID NO: 3420
  derived and/or modified CDS sequence (AUadapt) from InfluenzaA__ACV49676__HA

SEQ ID NO: 3533 - RNA, 1701 nt, Artificial Sequence; identical to SEQ ID NO: 62
  derived and/or modified CDS sequence (AUadapt) from InfluenzaA__ACV53450__HA

SEQ ID NO: 3534 - RNA, 1701 nt, Artificial Sequence; identical to SEQ ID NO: 62
  derived and/or modified CDS sequence (AUadapt) from InfluenzaA__ACV53460__HA

SEQ ID NO: 3535 - RNA, 1701 nt, Artificial Sequence; identical to SEQ ID NO: 62
  derived and/or modified CDS sequence (AUadapt) from InfluenzaA__ACV53480__HA

SEQ ID NO: 3536 - RNA, 1701 nt, Artificial Sequence
  derived and/or modified CDS sequence (AUadapt) from InfluenzaA__ACV53490__HA
auggaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcgacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccacaacauccaccccaucacgaucgggaagugccccaaguacgugaaguccaccaagcugcggcucgcgaccggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagacgcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 3537 - RNA, 1701 nt, Artificial Sequence
  derived and/or modified CDS sequence (AUadapt) from InfluenzaA__ACV53500__HA
auggaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccacaacauccaccccaucacgaucgggaagugccccaaguacgugaaguccaccaagcugcggcucgcgaccggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagacgcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 3538 - RNA, 1701 nt, Artificial Sequence
  derived and/or modified CDS sequence (AUadapt) from InfluenzaA__ACV53880__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccaccgccugcccgcacgccggcgccaaguccuucuacaagaaccugaucuggcucgugaagaaggggaacucguaccccaagcuguccaagagcuacaucaacgacaagggcaaggaggugcugguccucugggggauccaccaccccucgacguccgcggaccagcagagccuguaccagaacgccgacgccuacguguucgugggcaccucccgguacucgaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggccaucuacuccaccgucgcgucgagccuggugcucguggucucccugggggccaucucguucuggaugugcuccaacggcagccugcagugccggaucugcaucuga

SEQ ID NO: 3539 - RNA, 1701 nt, Artificial Sequence; identical to SEQ ID NO: 116
  derived and/or modified CDS sequence (AUadapt) from InfluenzaA__ACV53881__HA

SEQ ID NO: 3540 - RNA, 1701 nt, Artificial Sequence; identical to SEQ ID NO: 62
  derived and/or modified CDS sequence (AUadapt) from InfluenzaA__ACV53882__HA

SEQ ID NO: 3541 - RNA, 1701 nt, Artificial Sequence; identical to SEQ ID NO: 116
  derived and/or modified CDS sequence (AUadapt) from InfluenzaA__ACV53883__HA

SEQ ID NO: 3542 - RNA, 1701 nt, Artificial Sequence; identical to SEQ ID NO: 116
  derived and/or modified CDS sequence (AUadapt) from InfluenzaA__ACV53885__HA

SEQ ID NO: 3543 - RNA, 1701 nt, Artificial Sequence
  derived and/or modified CDS sequence (AUadapt) from InfluenzaA__ACV53899__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccggagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 3544 - RNA, 1701 nt, Artificial Sequence; identical to SEQ ID NO: 116
  derived and/or modified CDS sequence (AUadapt) from InfluenzaA__ACV53909__HA

SEQ ID NO: 3545 - RNA, 1701 nt, Artificial Sequence; identical to SEQ ID NO: 116
  derived and/or modified CDS sequence (AUadapt) from InfluenzaA__ACV67220__HA

SEQ ID NO: 3546 - RNA, 1701 nt, Artificial Sequence
  derived and/or modified CDS sequence (AUadapt) from InfluenzaA__ACV67221__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcggcagccuguccaccgccucguccuggagcuacaucguggagaccuccucguccgacaacggcacgugcuaccccggggacuucaucgacuacgaggagcuccgggagcagcugagcuccgugucguccuucgagcgcuucgagaucuuccccaagaccagcuccuggcccaaccacgacucgaacaagggcgucaccgccgccugcccgcacgccggggcgaaguccuucuacaagaaccugaucuggcucgugaagaagggcaacagcuaccccaagcuguccaagucguacaucaacgacaaggggaaggaggugcugguccucuggggcauccaccaccccagcaccuccgccgaccagcagucgcuguaccaguccgccgacgccuacguguucgugggcacgagccgguacuccaagaaguucaagcccgagaucgccauccgcccgaagguccgggaccaggaggggcgcaugaacuacuacuggacccugguggagcccggcgacaagaucaccuucgaggcgaccgggaaccucguggucccccgguacgccuucgccauggagcgcaacgccggcucgggcaucaucaucuccgacacgcccgugcacgacugcaacacgaccugccagaccccgaagggggccaucaacaccagccugcccuuccagaacauccaccccaucaccaucggcaagugccccaaguacgugaaguccaccaagcugcggcucgcgaccgggcugcgcaacgucccgucgauccagucccggggccuguucggggccaucgccggcuucaucgagggcggguggacgggcaugguggacgggugguacggcuaccaccaccagaacgagcaggggagcggcuacgccgccgaccucaaguccacccagaacgcgaucgacgagaucaccaacaaggugaacucggucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacuccaacgugaagaaccucuacgagaagguccgcagccagcugaagaacaacgccaaggagaucggcaacgggugcuucgaguucuaccacaagugcgacaacacgugcauggaguccgugaagaacggcaccuacgacuaccccaaguacucggaggaggccaagcugaaccgggaggagaucgacggggugaagcucgaguccacccgcaucuaccagauccuggcgaucuacagcaccgucgccucgucccuggugcucguggucagccugggcgccaucuccuucuggaugugcagcaacggcucccugcagugccggaucugcaucuga

SEQ ID NO: 3547 - RNA, 1701 nt, Artificial Sequence; identical to SEQ ID NO: 62
  derived and/or modified CDS sequence (AUadapt) from InfluenzaA__ACV67222__HA

SEQ ID NO: 3548 - RNA, 1701 nt, Artificial Sequence; identical to SEQ ID NO: 2940
  derived and/or modified CDS sequence (AUadapt) from InfluenzaA__ACV67223__HA

SEQ ID NO: 3549 - RNA, 1701 nt, Artificial Sequence; identical to SEQ ID NO: 3156
  derived and/or modified CDS sequence (AUadapt) from InfluenzaA__ACV67224__HA

SEQ ID NO: 3550 - RNA, 1701 nt, Artificial Sequence; identical to SEQ ID NO: 96
  derived and/or modified CDS sequence (AUadapt) from InfluenzaA__ACV67225__HA

SEQ ID NO: 3551 - RNA, 1701 nt, Artificial Sequence; identical to SEQ ID NO: 116
  derived and/or modified CDS sequence (AUadapt) from InfluenzaA__ACV67226__HA

SEQ ID NO: 3552 - RNA, 1701 nt, Artificial Sequence
  derived and/or modified CDS sequence (AUadapt) from InfluenzaA__ACV67227__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcaacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 3553 - RNA, 1701 nt, Artificial Sequence; identical to SEQ ID NO: 3156
  derived and/or modified CDS sequence (AUadapt) from InfluenzaA__ACV67228__HA

SEQ ID NO: 3554 - RNA, 1701 nt, Artificial Sequence
  derived and/or modified CDS sequence (AUadapt) from InfluenzaA__ACV67229__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaaccccaucgacgagaucaccaacaaggugaacuccgucaucgagaagaugaacacccaguucacggcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggccaucuacuccaccgucgcgucgagccuggugcucguggucucccugggggccaucucguucuggaugugcuccaacggcagccugcagugccggaucugcaucuga

SEQ ID NO: 3555 - RNA, 1701 nt, Artificial Sequence; identical to SEQ ID NO: 62
  derived and/or modified CDS sequence (AUadapt) from InfluenzaA__ACV67230__HA

SEQ ID NO: 3556 - RNA, 1701 nt, Artificial Sequence; identical to SEQ ID NO: 116
  derived and/or modified CDS sequence (AUadapt) from InfluenzaA__ACV67231__HA

SEQ ID NO: 3557 - RNA, 1701 nt, Artificial Sequence; identical to SEQ ID NO: 116
  derived and/or modified CDS sequence (AUadapt) from InfluenzaA__ACV67232__HA

SEQ ID NO: 3558 - RNA, 1701 nt, Artificial Sequence; identical to SEQ ID NO: 62
  derived and/or modified CDS sequence (AUadapt) from InfluenzaA__ACV67233__HA

SEQ ID NO: 3559 - RNA, 1701 nt, Artificial Sequence; identical to SEQ ID NO: 3156
  derived and/or modified CDS sequence (AUadapt) from InfluenzaA__ACV67234__HA

SEQ ID NO: 3560 - RNA, 1701 nt, Artificial Sequence
  derived and/or modified CDS sequence (AUadapt) from InfluenzaA__ACV67235__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaacgagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 3561 - RNA, 1701 nt, Artificial Sequence; identical to SEQ ID NO: 3158
  derived and/or modified CDS sequence (AUadapt) from InfluenzaA__ACV67236__HA

SEQ ID NO: 3562 - RNA, 1701 nt, Artificial Sequence; identical to SEQ ID NO: 62
  derived and/or modified CDS sequence (AUadapt) from InfluenzaA__ACV67238__HA

SEQ ID NO: 3563 - RNA, 1701 nt, Artificial Sequence
  derived and/or modified CDS sequence (AUadapt) from InfluenzaA__ACV67239__HA
augaaggccauccuggugguccuccuguacaccuucaccacggccaacgcggacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagacguccucguccgacaacgggaccugcuaccccggcgacuucaucgacuacgaggagcuccgggagcagcugagcuccgugucguccuucgagcgcuucgagaucuuccccaagaccagcuccuggcccaaccacgacucgaacaagggcgucaccgccgccugcccgcacgccggcgccaaguccuucuacaagaaccugaucuggcucgugaagaaggggaacagcuaccccaagcuguccaagucguacaucaacgacaagggcaaggaggugcugguccucugggggauccaccaccccagcacguccgcggaccagcagucgcuguaccagaacgccgacgccuacguguucgugggcuccagccgguacuccaagaaguucaagcccgagaucgccauccgcccgaagguccgggaccaggagggccgcaugaacuacuacuggacccugguggagcccggggacaagaucaccuucgaggccaccggcaaccucguggucccccgguacgcguucgccauggagcgcaacgccgggucgggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgccaccggccugcgcaacgucccgucgauccagucccgggggcuguucggcgcgaucgccggguucaucgagggcggcuggacggggaugguggacggcugguacggguaccaccaccagaacgagcagggcagcggguacgccgccgaccucaaguccacccagaacgccaucgacgagaucaccaacaaggugaacucggucaucgagaagaugaacacccaguucacggcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcaacaacacgugcauggaguccgugaagaacgggaccuacgacuaccccaaguacucggaggaggccaagcugaaccgggaggagaucgacggcgugaagcucgaguccacccgcaucuaccagauccuggccaucuacagcaccgucgcgucgucccuggugcucguggucagccugggggccaucuccuucuggaugugcagcaacggcucccugcagugccggaucugcaucuga

SEQ ID NO: 3564 - RNA, 1701 nt, Artificial Sequence; identical to SEQ ID NO: 3158
  derived and/or modified CDS sequence (AUadapt) from InfluenzaA__ACV67240__HA

SEQ ID NO: 3565 - RNA, 1701 nt, Artificial Sequence
  derived and/or modified CDS sequence (AUadapt) from InfluenzaA__ACV67241__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaacgggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 3566 - RNA, 1701 nt, Artificial Sequence; identical to SEQ ID NO: 3156
  derived and/or modified CDS sequence (AUadapt) from InfluenzaA__ACV67242__HA

SEQ ID NO: 3567 - RNA, 1701 nt, Artificial Sequence; identical to SEQ ID NO: 96
  derived and/or modified CDS sequence (AUadapt) from InfluenzaA__ACV67244__HA

SEQ ID NO: 3568 - RNA, 1701 nt, Artificial Sequence; identical to SEQ ID NO: 3007
  derived and/or modified CDS sequence (AUadapt) from InfluenzaA__ACV67246__HA

SEQ ID NO: 3569 - RNA, 1701 nt, Artificial Sequence; identical to SEQ ID NO: 3538
  derived and/or modified CDS sequence (AUadapt) from InfluenzaA__ACV67247__HA

SEQ ID NO: 3570 - RNA, 1701 nt, Artificial Sequence; identical to SEQ ID NO: 62
  derived and/or modified CDS sequence (AUadapt) from InfluenzaA__ACV70073__HA

SEQ ID NO: 3571 - RNA, 1701 nt, Artificial Sequence; identical to SEQ ID NO: 62
  derived and/or modified CDS sequence (AUadapt) from InfluenzaA__ACV70093__HA

SEQ ID NO: 3572 - RNA, 1701 nt, Artificial Sequence; identical to SEQ ID NO: 62
  derived and/or modified CDS sequence (AUadapt) from InfluenzaA__ACV70103__HA

SEQ ID NO: 3573 - RNA, 1701 nt, Artificial Sequence; identical to SEQ ID NO: 62
  derived and/or modified CDS sequence (AUadapt) from InfluenzaA__ACV70113__HA

SEQ ID NO: 3574 - RNA, 1701 nt, Artificial Sequence; identical to SEQ ID NO: 62
  derived and/or modified CDS sequence (AUadapt) from InfluenzaA__ACV70123__HA

SEQ ID NO: 3575 - RNA, 1701 nt, Artificial Sequence; identical to SEQ ID NO: 62
  derived and/or modified CDS sequence (AUadapt) from InfluenzaA__ACV70154__HA

SEQ ID NO: 3576 - RNA, 1701 nt, Artificial Sequence
  derived and/or modified CDS sequence (AUadapt) from InfluenzaA__ACV70164__HA
augaaggccauccuggugguccuccuguacaccuucaccacggccaacgcggacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagacguccucguccgacaacgggaccugcuaccccggcgacuucaucgacuacgaggagcuccgggagcagcugagcuccgugucguccuucgagcgcuucgagaucuuccccaagaccagcuccuggcccaaccacgacagcaacaagggggucaccgccgccugcccgcacgccggcgccaaguccuucuacaagaaccugaucuggcucgugaagaaggggaacucguaccccaagcuguccaagagcuacaucaacgacaagggcaaggaggugcugguccucugggggauccaccaccccucgacguccgcggaccagcagagccuguaccagaacgccgacgccuacguguucgugggcuccucgcgguacuccaagaaguucaagcccgagaucgccauccgcccgaagguccgggaccaggagggccgcaugaacuacuacuggacccugguggagcccggggacaagaucaccuucgaggccaccggcaaccucguggucccccgguacgcguucgccauggagcgcaacgccgggagcggcaucaucaucuccgacacgcccgugcacgacugcaacacgaccugccagacccugaagggcgccaucaacaccucgcugccguuccagaacauccaccccaucaccaucgggaagugccccaaguacgugaaguccaccaagcuccggcuggccaccggccugcgcaacguccccagcauccagucccggggccucuucggcgcgaucgccggguucaucgagggcggcuggacggggaugguggacggcugguacggguaccaccaccagaacgagcagggcagcggguacgccgccgaccugaaguccacccagaacgccaucgacgagaucaccaacaaggugaacucggucaucgagaagaugaacacccaguucacggcggugggcaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacuccaacgugaagaaccuguacgagaagguccgcagccagcugaagaacaacgccaaggagaucgggaacggcugcuucgaguucuaccacaagugcgacaacacgugcauggaguccgugaagaacgggaccuacgacuacccgaaguacucggaggaggccaagcucaaccgggaggagaucgacggcgugaagcuggaguccacccgcaucuaccagauccuggccaucuacagcaccgucgcgucgucccucgugcugguggucagccugggggccaucuccuucuggaugugcagcaacggcucccuccagugccggaucugcaucuga

SEQ ID NO: 3577 - RNA, 1701 nt, Artificial Sequence; identical to SEQ ID NO: 62
  derived and/or modified CDS sequence (AUadapt) from InfluenzaA__ACV70174__HA

SEQ ID NO: 3578 - RNA, 1701 nt, Artificial Sequence; identical to SEQ ID NO: 62
  derived and/or modified CDS sequence (AUadapt) from InfluenzaA__ACV70184__HA

SEQ ID NO: 3579 - RNA, 1701 nt, Artificial Sequence; identical to SEQ ID NO: 62
  derived and/or modified CDS sequence (AUadapt) from InfluenzaA__ACV70194__HA

SEQ ID NO: 3580 - RNA, 1701 nt, Artificial Sequence; identical to SEQ ID NO: 62
  derived and/or modified CDS sequence (AUadapt) from InfluenzaA__ACV70204__HA

SEQ ID NO: 3581 - RNA, 1701 nt, Artificial Sequence; identical to SEQ ID NO: 62
  derived and/or modified CDS sequence (AUadapt) from InfluenzaA__ACV70214__HA

SEQ ID NO: 3582 - RNA, 1701 nt, Artificial Sequence; identical to SEQ ID NO: 62
  derived and/or modified CDS sequence (AUadapt) from InfluenzaA__ACV70224__HA

SEQ ID NO: 3583 - RNA, 1701 nt, Artificial Sequence; identical to SEQ ID NO: 62
  derived and/or modified CDS sequence (AUadapt) from InfluenzaA__ACV70234__HA

SEQ ID NO: 3584 - RNA, 1701 nt, Artificial Sequence; identical to SEQ ID NO: 62
  derived and/or modified CDS sequence (AUadapt) from InfluenzaA__ACV70254__HA

SEQ ID NO: 3585 - RNA, 1701 nt, Artificial Sequence; identical to SEQ ID NO: 62
  derived and/or modified CDS sequence (AUadapt) from InfluenzaA__ACV70264__HA

SEQ ID NO: 3586 - RNA, 1701 nt, Artificial Sequence; identical to SEQ ID NO: 62
  derived and/or modified CDS sequence (AUadapt) from InfluenzaA__ACV70274__HA

SEQ ID NO: 3587 - RNA, 1701 nt, Artificial Sequence; identical to SEQ ID NO: 62
  derived and/or modified CDS sequence (AUadapt) from InfluenzaA__ACV70284__HA

SEQ ID NO: 3588 - RNA, 1701 nt, Artificial Sequence; identical to SEQ ID NO: 62
  derived and/or modified CDS sequence (AUadapt) from InfluenzaA__ACV70294__HA

SEQ ID NO: 3589 - RNA, 1701 nt, Artificial Sequence; identical to SEQ ID NO: 62
  derived and/or modified CDS sequence (AUadapt) from InfluenzaA__ACV70304__HA

SEQ ID NO: 3590 - RNA, 1701 nt, Artificial Sequence; identical to SEQ ID NO: 3576
  derived and/or modified CDS sequence (AUadapt) from InfluenzaA__ACV70314__HA

SEQ ID NO: 3591 - RNA, 1701 nt, Artificial Sequence
  derived and/or modified CDS sequence (AUadapt) from InfluenzaA__ACV70324__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguucaccgcguccucgugguccuacaucguggagaccagcuccucggacaacggcacgugcuaccccggcgacuucaucgacuacgaggagcuccgggagcagcuguccagcguguccucguucgagcgcuucgagaucuuccccaagaccuccagcuggcccaaccacgacuccaacaagggggucaccgccgccugcccgcacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacguguucgugggcagcucccgguacucgaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucacgaucgggaagugccccaaguacgucaagucgaccaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgacccgcaucuaccagauccuggcgaucuacuccaccgucgccagcucgcuggugcucguggucucccugggggccaucagcuucuggaugugcuccaacggcagccugcagugccggaucugcaucuga

SEQ ID NO: 3592 - RNA, 1701 nt, Artificial Sequence; identical to SEQ ID NO: 62
  derived and/or modified CDS sequence (AUadapt) from InfluenzaA__ACV70334__HA

SEQ ID NO: 3593 - RNA, 1701 nt, Artificial Sequence; identical to SEQ ID NO: 62
  derived and/or modified CDS sequence (AUadapt) from InfluenzaA__ACV70344__HA

SEQ ID NO: 3594 - RNA, 1701 nt, Artificial Sequence; identical to SEQ ID NO: 62
  derived and/or modified CDS sequence (AUadapt) from InfluenzaA__ACV70354__HA

SEQ ID NO: 3595 - RNA, 1701 nt, Artificial Sequence; identical to SEQ ID NO: 62
  derived and/or modified CDS sequence (AUadapt) from InfluenzaA__ACV70364__HA

SEQ ID NO: 3596 - RNA, 1701 nt, Artificial Sequence; identical to SEQ ID NO: 62
  derived and/or modified CDS sequence (AUadapt) from InfluenzaA__ACV70374__HA

SEQ ID NO: 3597 - RNA, 1701 nt, Artificial Sequence; identical to SEQ ID NO: 62
  derived and/or modified CDS sequence (AUadapt) from InfluenzaA__ACV70384__HA

SEQ ID NO: 3598 - RNA, 1701 nt, Artificial Sequence; identical to SEQ ID NO: 62
  derived and/or modified CDS sequence (AUadapt) from InfluenzaA__ACV70394__HA

SEQ ID NO: 3599 - RNA, 1701 nt, Artificial Sequence; identical to SEQ ID NO: 62
  derived and/or modified CDS sequence (AUadapt) from InfluenzaA__ACV70404__HA

SEQ ID NO: 3600 - RNA, 1701 nt, Artificial Sequence; identical to SEQ ID NO: 3576
  derived and/or modified CDS sequence (AUadapt) from InfluenzaA__ACV70414__HA

SEQ ID NO: 3601 - RNA, 1701 nt, Artificial Sequence; identical to SEQ ID NO: 62
  derived and/or modified CDS sequence (AUadapt) from InfluenzaA__ACV70424__HA

SEQ ID NO: 3602 - RNA, 1701 nt, Artificial Sequence; identical to SEQ ID NO: 62
  derived and/or modified CDS sequence (AUadapt) from InfluenzaA__ACV70434__HA

SEQ ID NO: 3603 - RNA, 1701 nt, Artificial Sequence; identical to SEQ ID NO: 62
  derived and/or modified CDS sequence (AUadapt) from InfluenzaA__ACV70444__HA

SEQ ID NO: 3604 - RNA, 1701 nt, Artificial Sequence; identical to SEQ ID NO: 62
  derived and/or modified CDS sequence (AUadapt) from InfluenzaA__ACV70454__HA

SEQ ID NO: 3605 - RNA, 1701 nt, Artificial Sequence; identical to SEQ ID NO: 62
  derived and/or modified CDS sequence (AUadapt) from InfluenzaA__ACV70464__HA

SEQ ID NO: 3606 - RNA, 1701 nt, Artificial Sequence; identical to SEQ ID NO: 62
  derived and/or modified CDS sequence (AUadapt) from InfluenzaA__ACV70474__HA

SEQ ID NO: 3607 - RNA, 1701 nt, Artificial Sequence; identical to SEQ ID NO: 62
  derived and/or modified CDS sequence (AUadapt) from InfluenzaA__ACV70484__HA

SEQ ID NO: 3608 - RNA, 1701 nt, Artificial Sequence; identical to SEQ ID NO: 62
  derived and/or modified CDS sequence (AUadapt) from InfluenzaA__ACV70494__HA

SEQ ID NO: 3609 - RNA, 1701 nt, Artificial Sequence; identical to SEQ ID NO: 62
  derived and/or modified CDS sequence (AUadapt) from InfluenzaA__ACV70504__HA

SEQ ID NO: 3610 - RNA, 1701 nt, Artificial Sequence; identical to SEQ ID NO: 62
  derived and/or modified CDS sequence (AUadapt) from InfluenzaA__ACV70514__HA

SEQ ID NO: 3611 - RNA, 1701 nt, Artificial Sequence; identical to SEQ ID NO: 62
  derived and/or modified CDS sequence (AUadapt) from InfluenzaA__ACV70524__HA

SEQ ID NO: 3612 - RNA, 1701 nt, Artificial Sequence; identical to SEQ ID NO: 96
  derived and/or modified CDS sequence (AUadapt) from InfluenzaA__ACV70534__HA

SEQ ID NO: 3613 - RNA, 1701 nt, Artificial Sequence; identical to SEQ ID NO: 62
  derived and/or modified CDS sequence (AUadapt) from InfluenzaA__ACV70544__HA

SEQ ID NO: 3614 - RNA, 1701 nt, Artificial Sequence; identical to SEQ ID NO: 62
  derived and/or modified CDS sequence (AUadapt) from InfluenzaA__ACV70564__HA

SEQ ID NO: 3615 - RNA, 1701 nt, Artificial Sequence; identical to SEQ ID NO: 62
  derived and/or modified CDS sequence (AUadapt) from InfluenzaA__ACV70584__HA

SEQ ID NO: 3616 - RNA, 1701 nt, Artificial Sequence; identical to SEQ ID NO: 3576
  derived and/or modified CDS sequence (AUadapt) from InfluenzaA__ACV70594__HA

SEQ ID NO: 3617 - RNA, 1701 nt, Artificial Sequence; identical to SEQ ID NO: 62
  derived and/or modified CDS sequence (AUadapt) from InfluenzaA__ACV70604__HA

SEQ ID NO: 3618 - RNA, 1701 nt, Artificial Sequence; identical to SEQ ID NO: 62
  derived and/or modified CDS sequence (AUadapt) from InfluenzaA__ACV70614__HA

SEQ ID NO: 3619 - RNA, 1701 nt, Artificial Sequence; identical to SEQ ID NO: 62
  derived and/or modified CDS sequence (AUadapt) from InfluenzaA__ACV70624__HA

SEQ ID NO: 3620 - RNA, 1701 nt, Artificial Sequence; identical to SEQ ID NO: 62
  derived and/or modified CDS sequence (AUadapt) from InfluenzaA__ACV70634__HA

SEQ ID NO: 3621 - RNA, 1701 nt, Artificial Sequence; identical to SEQ ID NO: 62
  derived and/or modified CDS sequence (AUadapt) from InfluenzaA__ACV70644__HA

SEQ ID NO: 3622 - RNA, 1701 nt, Artificial Sequence; identical to SEQ ID NO: 62
  derived and/or modified CDS sequence (AUadapt) from InfluenzaA__ACV70654__HA

SEQ ID NO: 3623 - RNA, 1701 nt, Artificial Sequence; identical to SEQ ID NO: 62
  derived and/or modified CDS sequence (AUadapt) from InfluenzaA__ACV70664__HA

SEQ ID NO: 3624 - RNA, 1701 nt, Artificial Sequence; identical to SEQ ID NO: 62
  derived and/or modified CDS sequence (AUadapt) from InfluenzaA__ACV70674__HA

SEQ ID NO: 3625 - RNA, 1701 nt, Artificial Sequence; identical to SEQ ID NO: 62
  derived and/or modified CDS sequence (AUadapt) from InfluenzaA__ACV70684__HA

SEQ ID NO: 3626 - RNA, 1701 nt, Artificial Sequence; identical to SEQ ID NO: 62
  derived and/or modified CDS sequence (AUadapt) from InfluenzaA__ACV70694__HA

SEQ ID NO: 3627 - RNA, 1701 nt, Artificial Sequence; identical to SEQ ID NO: 62
  derived and/or modified CDS sequence (AUadapt) from InfluenzaA__ACV70704__HA

SEQ ID NO: 3628 - RNA, 1701 nt, Artificial Sequence; identical to SEQ ID NO: 62
  derived and/or modified CDS sequence (AUadapt) from InfluenzaA__ACV70714__HA

SEQ ID NO: 3629 - RNA, 1701 nt, Artificial Sequence; identical to SEQ ID NO: 62
  derived and/or modified CDS sequence (AUadapt) from InfluenzaA__ACV70724__HA

SEQ ID NO: 3630 - RNA, 1701 nt, Artificial Sequence; identical to SEQ ID NO: 3538
  derived and/or modified CDS sequence (AUadapt) from InfluenzaA__ACV70734__HA

SEQ ID NO: 3631 - RNA, 1701 nt, Artificial Sequence; identical to SEQ ID NO: 62
  derived and/or modified CDS sequence (AUadapt) from InfluenzaA__ACV70744__HA

SEQ ID NO: 3632 - RNA, 1701 nt, Artificial Sequence; identical to SEQ ID NO: 62
  derived and/or modified CDS sequence (AUadapt) from InfluenzaA__ACV70754__HA

SEQ ID NO: 3633 - RNA, 1701 nt, Artificial Sequence; identical to SEQ ID NO: 62
  derived and/or modified CDS sequence (AUadapt) from InfluenzaA__ACV70764__HA

SEQ ID NO: 3634 - RNA, 1701 nt, Artificial Sequence; identical to SEQ ID NO: 62
  derived and/or modified CDS sequence (AUadapt) from InfluenzaA__ACV70784__HA

SEQ ID NO: 3635 - RNA, 1701 nt, Artificial Sequence
  derived and/or modified CDS sequence (AUadapt) from InfluenzaA__ACV70794__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggccaccgccgccugcccgcacgcgggcgccaagggguucuacaagaaccugaucuggcucgucaagaagggcaacuccuaccccaagcugagcaaguccuacaucaacgacaaggggaaggaggugcuggugcucuggggcauccaccaccccucgaccagcgccgaccagcagucccuguaccagaacgccgacgccuacgucuucgugggcucgucccgguacagcaagaaguucaagcccgagaucgcgauccgcccgaaggugcgggaccaggaggggcgcaugaacuacuacuggacgcuggucgagcccggcgacaagaucaccuucgaggccaccgggaaccucguggugccccgguacgccuucgccauggagcgcaacgccggcuccggcaucaucaucucggacacccccguccacgacugcaacacgaccugccagaccccgaagggggcgaucaacaccucccugcccuuccagaacauccaccccaucacgaucggcaagugccccaaguacgucaagagcaccaagcugcggcucgccaccgggcugcgcaacgugccguccauccagucgcggggccuguucggggccaucgccggcuucaucgagggcggguggaccggcaugguggacgggugguacggcuaccaccaccagaacgagcagggguccggcuacgccgcggaccucaagucgacgcagaacgccaucgacgagaucaccaacaaggugaacuccgugaucgagaagaugaacacccaguucaccgccgucggcaaggaguucaaccaccuggagaagcgcaucgagaaccugaacaagaagguggacgacggguuccucgacaucuggacguacaacgccgagcugcugguccuccuggagaacgagcggacccuggacuaccacgacagcaacgugaagaaccucuacgagaaggugcgcucccagcugaagaacaacgccaaggagaucggcaacgggugcuucgaguucuaccacaagugcgacaacacgugcauggagucggucaagaacggcaccuacgacuaccccaaguacuccgaggaggcgaagcugaaccgggaggagaucgacggggugaagcucgagagcacccgcaucuaccagauccuggccaucuacuccaccguggccucgagccugguccucguggugucccugggcgccaucucguucuggaugugcuccaacggcagccugcagugccggaucugcaucuga

SEQ ID NO: 3636 - RNA, 1701 nt, Artificial Sequence; identical to SEQ ID NO: 62
  derived and/or modified CDS sequence (AUadapt) from InfluenzaA__ACV70804__HA

SEQ ID NO: 3637 - RNA, 1701 nt, Artificial Sequence; identical to SEQ ID NO: 3576
  derived and/or modified CDS sequence (AUadapt) from InfluenzaA__ACV70824__HA

SEQ ID NO: 3638 - RNA, 1701 nt, Artificial Sequence; identical to SEQ ID NO: 62
  derived and/or modified CDS sequence (AUadapt) from InfluenzaA__ACV70834__HA

SEQ ID NO: 3639 - RNA, 1701 nt, Artificial Sequence
  derived and/or modified CDS sequence (AUadapt) from InfluenzaA__ACV70844__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaagggguucuacaagaaccugaucuggcucgugaagaagggcaacuccuaccccaagcugucgaaguccuacaucaacgacaaggggaaggaggugcugguccucuggggcauccaccaccccagcaccucggccgaccagcagucccuguaccagaacgccgacgccuacguguucgugggcagcucccgguacucgaagaaguucaagcccgagaucgccauccgcccgaagguccgggaccaggaggggcgcaugaacuacuacuggacgcugguggagcccggcgacaagaucaccuucgaggcgaccgggaaccuccuggugccccgguacgccuucgccauggagcgcaacgccggcuccggcaucaucaucagcgacacccccguccacgacugcaacacgaccugccagaccccgaagggggccaucaacaccucccugcccuuccagaacauccaccccaucacgaucggcaagugccccaaguacgucaagucgaccaagcuccggcuggcgaccgggcugcgcaacgugccguccauccagagccggggccucuucggggccaucgccggcuucaucgagggcggguggaccggcaugguggacgggugguacggcuaccaccaccagaacgagcagggguccggcuacgccgccgaccucaagucgacgcagaacgcgaucgacgagaucaccaacaaggugaacuccgugaucgagaagaugaacacccaguucaccgccgucggcaaggaguucaaccaccuggagaagcgcaucgagaaccugaacaagaagguggacgacggguuccuggacaucuggacguacaacgccgagcugcucguccugcuggagaacgagcggacccucgacuaccacgacagcaacgugaagaaccuguacgagaaggugcgcucccagcugaagaacaacgccaaggagaucggcaacgggugcuucgaguucuaccacaagugcgacaacacgugcauggagucggucaagaacggcaccuacgacuaccccaaguacuccgaggaggccaagcucaaccgggaggagaucgacggggugaagcuggagagcacccgcaucuaccagauccuggcgaucuacuccaccguggccucgagccucguccugguggugucccugggcgccaucucguucuggaugugcuccaacggcagccuccagugccggaucugcaucuga

SEQ ID NO: 3640 - RNA, 1701 nt, Artificial Sequence; identical to SEQ ID NO: 62
  derived and/or modified CDS sequence (AUadapt) from InfluenzaA__ACV70854__HA

SEQ ID NO: 3641 - RNA, 1701 nt, Artificial Sequence
  derived and/or modified CDS sequence (AUadapt) from InfluenzaA__ACV70864__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaccagcuaccccaagcuguccaagucguacaucaacgacaagggcaaggaggugcugguccucugggggauccaccaccccagcacguccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggucgggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgcgaccggccugcgcaacgucccgucgauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacucggucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 3642 - RNA, 1701 nt, Artificial Sequence; identical to SEQ ID NO: 62
  derived and/or modified CDS sequence (AUadapt) from InfluenzaA__ACV70874__HA

SEQ ID NO: 3643 - RNA, 1701 nt, Artificial Sequence; identical to SEQ ID NO: 96
  derived and/or modified CDS sequence (AUadapt) from InfluenzaA__ACV70884__HA

SEQ ID NO: 3644 - RNA, 1701 nt, Artificial Sequence
  derived and/or modified CDS sequence (AUadapt) from InfluenzaA__ACV70904__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacaucccgucgauccagucccgggggcuguucggcgccaucgccggguucaucgagggcggcuggaccgggauggucgacggcugguacggguaccaccaccagaacgagcagggcagcggguacgccgccgaccucaaguccacgcagaacgcgaucgacgagaucaccaacaaggugaacucggugaucgagaagaugaacacccaguucaccgccgucggcaaggaguucaaccaccuggagaagcgcaucgagaaccugaacaagaagguggacgacggcuuccucgacaucuggacguacaacgccgagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuaccccaaguacucggaggaggccaagcugaaccgggaggagaucgacggcgugaagcucgaguccacccgcaucuaccagauccuggcgaucuacagcaccguggccucgucccugguccucguggugagccugggggccaucuccuucuggaugugcagcaacggcucccugcagugccggaucugcaucuga

SEQ ID NO: 3645 - RNA, 1701 nt, Artificial Sequence; identical to SEQ ID NO: 62
  derived and/or modified CDS sequence (AUadapt) from InfluenzaA__ACV70914__HA

SEQ ID NO: 3646 - RNA, 1701 nt, Artificial Sequence; identical to SEQ ID NO: 62
  derived and/or modified CDS sequence (AUadapt) from InfluenzaA__ACV70924__HA

SEQ ID NO: 3647 - RNA, 1701 nt, Artificial Sequence; identical to SEQ ID NO: 62
  derived and/or modified CDS sequence (AUadapt) from InfluenzaA__ACV70934__HA

SEQ ID NO: 3648 - RNA, 1701 nt, Artificial Sequence; identical to SEQ ID NO: 62
  derived and/or modified CDS sequence (AUadapt) from InfluenzaA__ACV70944__HA

SEQ ID NO: 3649 - RNA, 1701 nt, Artificial Sequence
  derived and/or modified CDS sequence (AUadapt) from InfluenzaA__ACV70954__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccuccuggugccccgguacgccuucgccauggagcgcaacgccgggucgggcaucaucaucuccgacacccccguccacgacugcaacacgaccugccagaccccgaagggcgccaucaacaccagccugcccuuccagaacauccaccccaucacgaucgggaagugccccaaguacgugaaguccaccaagcuccggcuggcgaccggccugcgcaacgugccgucgauccagucccggggccucuucggggccaucgccggguucaucgagggcggcuggaccgggauggucgacggcugguacggguaccaccaccagaacgagcagggcagcggguacgccgccgaccugaaguccacgcagaacgcgaucgacgagaucaccaacaaggugaacucggugaucgagaagaugaacacccaguucaccgccgucggcaaggaguucaaccaccuggagaagcgcaucgagaaccucaacaagaagguggacgacggcuuccuggacaucuggacguacaacgccgagcugcucguccugcuggagaacgagcggacccucgacuaccacgacuccaacgugaagaaccuguacgagaaggugcgcagccagcugaagaacaacgccaaggagaucgggaacggcugcuucgaguucuaccacaagugcgacaacacgugcauggaguccgucaagaacgggaccuacgacuaccccaaguacucggaggaggccaagcucaaccgggaggagaucgacggcgugaagcuggaguccacccgcaucuaccagauccuggcgaucuacagcaccguggccucgucccucguccugguggugagccugggggccaucuccuucuggaugugcagcaacggcucccuccagugccggaucugcaucuga

SEQ ID NO: 3650 - RNA, 1701 nt, Artificial Sequence; identical to SEQ ID NO: 62
  derived and/or modified CDS sequence (AUadapt) from InfluenzaA__ACV70964__HA

SEQ ID NO: 3651 - RNA, 1701 nt, Artificial Sequence; identical to SEQ ID NO: 62
  derived and/or modified CDS sequence (AUadapt) from InfluenzaA__ACV70974__HA

SEQ ID NO: 3652 - RNA, 1701 nt, Artificial Sequence; identical to SEQ ID NO: 3644
  derived and/or modified CDS sequence (AUadapt) from InfluenzaA__ACV70984__HA

SEQ ID NO: 3653 - RNA, 1701 nt, Artificial Sequence; identical to SEQ ID NO: 3649
  derived and/or modified CDS sequence (AUadapt) from InfluenzaA__ACV70994__HA

SEQ ID NO: 3654 - RNA, 1701 nt, Artificial Sequence; identical to SEQ ID NO: 62
  derived and/or modified CDS sequence (AUadapt) from InfluenzaA__ACV71004__HA

SEQ ID NO: 3655 - RNA, 1701 nt, Artificial Sequence
  derived and/or modified CDS sequence (AUadapt) from InfluenzaA__ACV82230__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcaagaacugcacccugaucgacgcccugcucggggacccccagugcgacggcuuccagaacaagaagugggaccuguucguggagcgcagccaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaagaacagcuucuucucccgccugaacuggcucacgcaccugaacuucaaguaccaggcccugaacgugaccaugcccaacaacgagcaguucgacaagcucuacaucuggggcguccaccaccccgggaccgacaaggaccagaucuuccuguacgcgcaggccucggggcggaucaccguguccacgaagcgcagccagcagaccgugauccccaacaucggcucgcggccgcgcguccggaacauccccucccgcaucagcaucuacuggaccaucgugaagcccggcgacauccugcucaucaacuccaccgggaaccugaucgcgccccggggcuacuucaagauccagucggggaaguccucgaucaugcgcuccgacgccccgaucggcaagugcaacagcgagugcaucacgcccaacggcuccauccccaacgacaagcccuuccagaacgugaaccggaucaccuacggggccugcccgcgcuacgucaagcagaacacccugaagcucgccaccggcaugcggaacgugcccgagaagcagacgcgcgggaucuucggcgccaucgccggguucaucgagaacggcugggagggcaugguggacgggugguacggcuuccggcaccagaacucggaggggcgcggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 3656 - RNA, 1701 nt, Artificial Sequence
  derived and/or modified CDS sequence (AUadapt) from InfluenzaA__ACV82232__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccucggggcggaucaccguguccacgaagcgcagccagcaggccgugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccucgaucaugcgguccgacgcccccaucggcaagugcaacagcgagugcaucacccccaacggcuccauccccaacgacaagccguuccagaacgugaaccgcaucacguacggggcgugcccccgguacgucaagcagaacacccugaagcucgccaccggcaugcgcaacgugcccgagaagcagacccgggggaucuucggcgccaucgccggguucaucgagaacggcugggagggcaugguggacgggugguacggcuuccgccaccagaacucggaggggcggggccaggccgcggaccugaaguccacgcaggccgccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacaccaucgaccucacggacucggagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggcgugccagaaggggaacauccggugcaacaucugcaucuga

SEQ ID NO: 3657 - RNA, 1698 nt, Artificial Sequence
  derived and/or modified CDS sequence (AUadapt) from InfluenzaA__ACV82233__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacaaccacaacgggaagcucugccugcugaagggcaucgcgccccuccagcuggggaacugcagcgucgccggcuggauccuggggaacccggagugcgagcuccugaucuccaaggagagcugguccuacaucguggagaagcccaaccccgagaacgggaccugcuaccccggccacuucgccgacuacgaggagcugcgcgagcagcucucguccgugagcuccuucgagcgguucgagaucuucccgaaggagagcuccuggcccaaccacacggucaccggggugucggccuccugcagccacaacggcgagaacuccuucuaccgcaaccugcuguggcucaccgggaagaacggccuguaccccaaccugagcaaguccuacgccaacaacaaggagaaggaggugcucguccuguggggcgugcaccacccgcccaacaucgccgaccagaagacccuguaccacacggagaacgccuacgugucggucguguccagccacuacagccggaaguucacccccgagaucgccaagcgccccaagauccgggaccaggagggccgcaucaacuacuacuggacccuccuggagcccggcgacaccaucaucuucgaggcgaacgggaaccugaucgccccgcgguacgccuucgcccucucccgcggcuucgggucgggcaucaucaacuccaacgcccccauggacaagugcgacgcgaagugccagacgccccagggcgccaucaacagcucccugcccuuccagaacgugcacccggucaccaucggggagugccccaaguacgugcggagcgccaagcugcgcauggugaccggccuccggaacauccccuccauccagucgcgcgggcuguucggcgccaucgccggguucaucgagggcggcuggaccgggauggucgacggcugguacggguaccaccaccagaacgagcagggcuccggguacgcggccgaccagaaguccacgcagaacgccaucaacggcaucaccaacaaggugaacagcgugaucgagaagaugaacacccaguucaccgccgucggcaaggaguucaacaagcuggagcggcgcauggagaaccucaacaagaagguggacgacggguucaucgacaucuggacguacaacgccgagcugcugguccuccuggagaacgagcggacccuggacuuccacgacagcaacgugaagaaccucuacgagaaggugaagucccagcugaagaacaacgcgaaggagaucggcaacgggugcuucgaguucuaccacaagugcaacgacgagugcauggagucggucaagaacggcaccuacgacuaccccaaguacuccgaggagagcaagcugaaccgcgagaagaucgacggggugaagcucgaguccaugggcguguaccagauccuggccaucuacagcaccgucgccuccucgcuggugcuccuggugagccugggcgccaucuccuucuggaugugcagcaacgggucccuccagugccggaucugcaucuga

SEQ ID NO: 3658 - RNA, 1701 nt, Artificial Sequence
  derived and/or modified CDS sequence (AUadapt) from InfluenzaA__ACV83662__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccgcgagggccggaugaacuacuacuggacccugguggagcccggggacaagaucaccuucgaggcgaccggcaaccucguggucccccgcuacgccuucgccauggugcggaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagucgcgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggucaacuccgugaucgagaagaugaacacccaguucacggccgucggcaaggaguucaaccaccuggagaagcggaucgagaaccugaacaagaagguggacgacggcuuccucgacaucuggaccuacaacgccgagcugcuggugcuccuggagaacgagcgcacccuggacuaccacgacucgaacgucaagaaccucuacgagaaggugcggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgucaagcucgagucgacccggaucuaccagauccuggcgaucuacuccaccguggccagcucgcuggugcucgucgugucccugggggccaucagcuucuggaugugcuccaacggcagccugcagugccgcaucugcaucuga

SEQ ID NO: 3659 - RNA, 1701 nt, Artificial Sequence
  derived and/or modified CDS sequence (AUadapt) from InfluenzaA__ACV83663__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccggggccaggaggggcgcaugaacuacuacuggacccugguggagcccggcgacaagaucaccuucgaggcgaccgggaaccucguggucccccgguacgccuucgccauggagcgcaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagucgaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcucgagagcacccgcaucuaccagauccuggcgaucuacuccaccgucgccucgagccuggugcucguggucucccugggcgccaucucguucuggaugugcuccaacggcagccugcagugccggaucugcaucuga

SEQ ID NO: 3660 - RNA, 1701 nt, Artificial Sequence; identical to SEQ ID NO: 3659
  derived and/or modified CDS sequence (AUadapt) from InfluenzaA__ACV83664__HA

SEQ ID NO: 3661 - RNA, 1701 nt, Artificial Sequence
  derived and/or modified CDS sequence (AUadapt) from InfluenzaA__ACV83665__HA
auggaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccaucgccgaccagcagucccuguaccagaacgccgacgccuacguguucgugggcucgucccgguacagcaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccggguccggcaucaucaucucggacacccccgugcacgacugcaacacgaccugccagaccccgaagggcgccaucaacaccucccugcccuuccacaacauccaccccaucacgaucgggaagugccccaaguacgucaagagcaccaagcugcggcucgcgaccggccugcgcaacgugccguccauccagucgcgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgacccgcaucuaccagauccuggcgaucuacuccaccgucgccagcucgcuggugcucguggucucccugggggccaucagcuucuggaugugcuccaacggcagccugcagugccggaucugcaucuga

SEQ ID NO: 3662 - RNA, 1701 nt, Artificial Sequence
  derived and/or modified CDS sequence (AUadapt) from InfluenzaA__ACV83667__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccggaaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 3663 - RNA, 1701 nt, Artificial Sequence; identical to SEQ ID NO: 116
  derived and/or modified CDS sequence (AUadapt) from InfluenzaA__ACV83668__HA

SEQ ID NO: 3664 - RNA, 1701 nt, Artificial Sequence; identical to SEQ ID NO: 116
  derived and/or modified CDS sequence (AUadapt) from InfluenzaA__ACV83670__HA

SEQ ID NO: 3665 - RNA, 1701 nt, Artificial Sequence; identical to SEQ ID NO: 3156
  derived and/or modified CDS sequence (AUadapt) from InfluenzaA__ACV83671__HA

SEQ ID NO: 3666 - RNA, 1701 nt, Artificial Sequence; identical to SEQ ID NO: 3476
  derived and/or modified CDS sequence (AUadapt) from InfluenzaA__ACV88399__HA

SEQ ID NO: 3667 - RNA, 1701 nt, Artificial Sequence; identical to SEQ ID NO: 3476
  derived and/or modified CDS sequence (AUadapt) from InfluenzaA__ACV88409__HA

SEQ ID NO: 3668 - RNA, 1701 nt, Artificial Sequence; identical to SEQ ID NO: 62
  derived and/or modified CDS sequence (AUadapt) from InfluenzaA__ACV88419__HA

SEQ ID NO: 3669 - RNA, 1698 nt, Artificial Sequence; identical to SEQ ID NO: 3523
  derived and/or modified CDS sequence (AUadapt) from InfluenzaA__ACV89502__HA

SEQ ID NO: 3670 - RNA, 1701 nt, Artificial Sequence
  derived and/or modified CDS sequence (AUadapt) from InfluenzaA__ACV89516__HA
augaaggcccgccugcucauccugcugugcgcccucgcggccaccgacgccgacaccaucugcaucggcuaccacgccaacaacucgacggacaccguggacaccguccuggagaagaacgugaccgugacgcacuccgucaaccugcucgaggacagccacaacgggaagcugugccggcugaagggcaucgcgccccuccagcuggggaagugcaacaucgccggcuggauccuggggaacccggagugcgacucccuccugcccgccagcuccuggucguacaucguggagacccccaacuccaagaacggcaucugcuaccccggcgacuucaucgacuacgaggagcugcgcgagcagcucagcuccgugagcuccuucgagcgguucgagaucuucccgaaggagucguccuggcccaagcacagcaccaccaagggggucacggccgccugcucccacgcgggcaagagcuccuucuaccgcaaccugcuguggcucaccaagaagggggacagcuaccccaagcuguccaacucguacgugaacaagaagggcaaggaggugcugguccucuggggcgugcaccaccccagcuccagcaaggagcagcagacccuguaccagaacgagaacgccuacguguccgucgugucguccaacuacaaccggcgcuucaucccggagaucgccgagcggcccgaggugaaggaccaggccgggcgcaucaacuacuacuggacccugcucgagcccggcgacacgaucaucuucgaggccaacgggaaccuggucgcgcccugguacgccuucgcccugagccggggcuucggguccggcaucaucaccagcaacgccuccaugcacgagugcaacaccaagugccagaccccgcagggcgccaucaacucgucccuccccuuccagaacauccaccccgugacgaucggggagugccccaaguacgucaagagcgcgaagcugcgcauggugaccggccugcggaacaucccguccauccagagccgcggccucuucggggccaucgccggguucaucgagggcggcuggaccgggaugaucgacggcugguacggguaccaccaccagaacgagcagggcuccggguacgccgccgaccagaaguccacccagaacgcgaucaacggcaucacgaacaaggugaacagcgugaucgagaagaugaacacccaguucaccgccgucggcaaggaguucaacaaccuggagaagcggauggagaaccugaacaagaagguggacgacggguuccucgacaucuggaccuacaacgccgagcugcuggugcuccuggagaacgagcgcacgcuggacuuccacgacucgaacgucaagaaccucuacgagaaggugaagauccagcugaagaacaacgccaaggagaucggcaacgggugcuucgaguucuaccacaagugcgacaacgagugcauggaguccguccggaacggcaccuacgacuaccccaaguacagcaaggagagcaagcugaaccgcgagaagaucgacggggugaagcucgaguccaugggcguguaccagauccuggccaucuacucgaccgucgcguccagccuggugcuccuggugucccugggcgccaucagcuucuggaugugcuccaacgggagccuccagugccggaucugcaucuga

SEQ ID NO: 3671 - RNA, 1698 nt, Artificial Sequence
  derived and/or modified CDS sequence (AUadapt) from InfluenzaA__ACV90512__HA
augaacgugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccucguggcccaaccacacggucaccgggguguccgccagcugcucccacaacggcgagaacagcuucuaccgcaaccugcuguggcucaccgggaagaacggccuguaccccaaccuguccaagucguacgccaacaacaaggagaaggaggugcucguccuguggggcgugcaccacccgcccaacaucgccgaccagaagacccuguaccacacggagaacgccuacguguccgucgugagcagccacuacucccggaaguucacccccgagaucgccaagcgccccaaggugcgggaccaggagggccgcaucaacuacuacuggacccuccuggagcccggcgacaccaucaucuucgaggcgaacgggaaccugaucgccccgcgguacgccuucgcccucucgcgcggcuucggguccggcaucaucaacagcaacgcccccaucgacaagugggacgcgaagugccagacgccccagggcgccaucaacuccagccugcccuuccagaacguccacccggugaccaucggggaguggcccaaguacgugcgguccgccaagcugcgcauggucaccggccuccggaacauccccucgauccagucccgcgggcuguucggcgccaucgccggguucaucgagggcggcuggaccgggaugguggacggcugguacggguaccaccaccagaacgagcagggcagcggguacgcggccgaccagaaguccacgcagaacgccaucaacggcaucaccaacaagaugaacagcgugaucgagaagaugaacacccaguucaccgccgucggcaaggaguucaacaagcuggagcggcgcauggagaaccucaacaagaagguggacgacggguucaucgacaucuggacguacaacgccgagcugcugguccuccuggagaacgagcggacccuggacuuccacgacuccaacgugaagaaccucuacgagaaggucaagucgcagcugaagaacaacgcgaaggagaucggcaacgggugcuucgaguucuaccacaagugcaacgacgagugcauggaguccgugaagaacggcaccuacgacuaccccaaguacagcgaggaguccaagcugaaccgcgagaagaucgacggggugacccucgagagcaugggcguguaccagauccuggccaucuacuccacggucgccucgagccuggugcuccuggugucccugggcgccaucagcuucuggaugugcuccaacgggagccuccagugccggaucugcaucuga

SEQ ID NO: 3672 - RNA, 1701 nt, Artificial Sequence; identical to SEQ ID NO: 116
  derived and/or modified CDS sequence (AUadapt) from InfluenzaA__ACV91672__HA

SEQ ID NO: 3673 - RNA, 1701 nt, Artificial Sequence; identical to SEQ ID NO: 116
  derived and/or modified CDS sequence (AUadapt) from InfluenzaA__ACV91676__HA

SEQ ID NO: 3674 - RNA, 1701 nt, Artificial Sequence; identical to SEQ ID NO: 116
  derived and/or modified CDS sequence (AUadapt) from InfluenzaA__ACV91680__HA

SEQ ID NO: 3675 - RNA, 1701 nt, Artificial Sequence
  derived and/or modified CDS sequence (AUadapt) from InfluenzaA__ACX31591__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaagaacagcuucuucucccgccugaacuggcucacgcaccugaacuucaaguaccaggcccugaacgugaccaugcccaacaacgagcaguucgacaagcucuacaucuggggcguccaccaccccgggaccgacaaggaccagaucuuccuguacgcgcaggccucggggcggaucaccguguccacgaagcgcagccagcagaccgugauccccaacaucggcucgcggccgcgcguccggaacauccccucccgcaucagcaucuacuggaccaucgugaagcccggcgacauccugcucaucaacuccaccgggaaccugaucgcgccccggggcuacuucaagauccagucggggaaguccucgaucaugcgcuccgacgccccgaucggcaagugcaacagcgagugcaucacgcccaacggcuccauccccaacgacaagcccuuccagaacgugaaccggaucaccuacggggccugcccgcgcuacgucaagcagaacacccugaagcucgccaccggcaugcggaacgugcccgagaagcagacgcgcgggaucuucggcgccaucgccggguucaucgagaacggcugggagggcaugguggacgggugguacggcuuccggcaccagaacucggaggggcgcggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 3676 - RNA, 1701 nt, Artificial Sequence
  derived and/or modified CDS sequence (AUadapt) from InfluenzaA__ACX31933__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccggcaacggcacgugcuaccccggggacuucaucgacuacgaggagcuccgggagcagcugucguccgugagcuccuucgagcgcuucgagaucuuccccaagaccucguccuggcccaaccacgacagcaacaagggcgucaccgccgccugcccgcacgccggggcgaaguccuucuacaagaaccugaucuggcucgugaagaagggcaacucguaccccaagcuguccaagagcuacaucaacgacaaggggaaggaggugcugguccucuggggcauccaccaccccucgaccuccgccgaccagcagagccuguaccagaacgccgacgccuacguguucgugggcacgucccgguacucgaagaaguucaagcccgagaucgccauccgcccgaagguccgggaccaggaggggcgcaugaacuacuacuggacccugguggagcccggcgacaagaucaccuucgaggcgaccgggaaccucguggucccccgguacgccuucgccauggagcgcaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagucgaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucaacggggugaagcucgagagcacccgcaucuaccagauccuggcgaucuacuccaccgucgccucgagccuggugcucguggucucccugggcgccaucucguucuggaugugcuccaacggcagccugcagugccggaucugcaucuga

SEQ ID NO: 3677 - RNA, 1701 nt, Artificial Sequence
  derived and/or modified CDS sequence (AUadapt) from InfluenzaA__ACX31934__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucaccauccgcccgaagguccggggccaggaggggcgcaugaacuacuacuggacccugguggagcccggcgacaagaucaccuucgaggccacggggaaccucguggucccccgguacgcguucgccauggagcgcaacgccggcuccggcaucaucaucagcgacacccccgugcacgacugcaacacgaccugccagaccccgaagggggccaucaacaccucccugcccuuccagaacauccaccccaucaccaucggcaagugccccaaguacgucaagucgaccaagcugcggcucgccacggggcugcgcaacgugccguccauccagagccggggccuguucggggcgaucgccggcuucaucgagggcggguggaccggcaugguggacgggugguacggcuaccaccaccagaacgagcagggguccggcuacgccgccgaccucaagucgacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcucgagagcacccgcaucuaccagauccuggccaucuacuccaccgucgcgucgagccuggugcucguggucucccugggcgccaucucguucuggaugugcuccaacggcagccugcagugccggaucugcaucuga

SEQ ID NO: 3678 - RNA, 1701 nt, Artificial Sequence; identical to SEQ ID NO: 116
  derived and/or modified CDS sequence (AUadapt) from InfluenzaA__ACX31935__HA

SEQ ID NO: 3679 - RNA, 1701 nt, Artificial Sequence; identical to SEQ ID NO: 116
  derived and/or modified CDS sequence (AUadapt) from InfluenzaA__ACX31936__HA

SEQ ID NO: 3680 - RNA, 1701 nt, Artificial Sequence; identical to SEQ ID NO: 3005
  derived and/or modified CDS sequence (AUadapt) from InfluenzaA__ACX31939__HA

SEQ ID NO: 3681 - RNA, 1701 nt, Artificial Sequence; identical to SEQ ID NO: 3005
  derived and/or modified CDS sequence (AUadapt) from InfluenzaA__ACX31940__HA

SEQ ID NO: 3682 - RNA, 1701 nt, Artificial Sequence; identical to SEQ ID NO: 116
  derived and/or modified CDS sequence (AUadapt) from InfluenzaA__ACX31943__HA

SEQ ID NO: 3683 - RNA, 1701 nt, Artificial Sequence; identical to SEQ ID NO: 116
  derived and/or modified CDS sequence (AUadapt) from InfluenzaA__ACX31946__HA

SEQ ID NO: 3684 - RNA, 1701 nt, Artificial Sequence; identical to SEQ ID NO: 116
  derived and/or modified CDS sequence (AUadapt) from InfluenzaA__ACX31947__HA

SEQ ID NO: 3685 - RNA, 1701 nt, Artificial Sequence; identical to SEQ ID NO: 116
  derived and/or modified CDS sequence (AUadapt) from InfluenzaA__ACX31948__HA

SEQ ID NO: 3686 - RNA, 1701 nt, Artificial Sequence
  derived and/or modified CDS sequence (AUadapt) from InfluenzaA__ACX31949__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacuacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgaggagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgacccgcaucuaccagauccuggcgaucuacuccaccgucgccagcucgcuggugcucguggucucccugggggccaucagcuucuggaugugcuccaacggcagccugcagugccggaucugcaucuga

SEQ ID NO: 3687 - RNA, 1701 nt, Artificial Sequence; identical to SEQ ID NO: 116
  derived and/or modified CDS sequence (AUadapt) from InfluenzaA__ACX31950__HA

SEQ ID NO: 3688 - RNA, 1701 nt, Artificial Sequence; identical to SEQ ID NO: 116
  derived and/or modified CDS sequence (AUadapt) from InfluenzaA__ACX31951__HA

SEQ ID NO: 3689 - RNA, 1701 nt, Artificial Sequence; identical to SEQ ID NO: 116
  derived and/or modified CDS sequence (AUadapt) from InfluenzaA__ACX31954__HA

SEQ ID NO: 3690 - RNA, 1701 nt, Artificial Sequence; identical to SEQ ID NO: 116
  derived and/or modified CDS sequence (AUadapt) from InfluenzaA__ACX31955__HA

SEQ ID NO: 3691 - RNA, 1701 nt, Artificial Sequence; identical to SEQ ID NO: 62
  derived and/or modified CDS sequence (AUadapt) from InfluenzaA__ACX31956__HA

SEQ ID NO: 3692 - RNA, 1701 nt, Artificial Sequence; identical to SEQ ID NO: 116
  derived and/or modified CDS sequence (AUadapt) from InfluenzaA__ACX31957__HA

SEQ ID NO: 3693 - RNA, 1701 nt, Artificial Sequence; identical to SEQ ID NO: 62
  derived and/or modified CDS sequence (AUadapt) from InfluenzaA__ACX31958__HA

SEQ ID NO: 3694 - RNA, 1701 nt, Artificial Sequence; identical to SEQ ID NO: 3156
  derived and/or modified CDS sequence (AUadapt) from InfluenzaA__ACX31960__HA

SEQ ID NO: 3695 - RNA, 1701 nt, Artificial Sequence
  derived and/or modified CDS sequence (AUadapt) from InfluenzaA__ACX31961__HA
augaaggccauccugguggucaugcucuacaccuucgccaccgcgaacgccgacacgcugugcaucggcuaccacgccaacaacucgaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagagccuguccaccgccucguccuggagcuacaucguggagaccuccucguccgacaacggcacgugcuaccccggcgacuucaucgacuacgaggagcugcgggagcagcucagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcuggugaagaaggggaacagcuaccccaagcucuccaagucguacaucaacgacaagggcaaggaggugcugguccugugggggauccaccaccccagcaccuccgccgaccagcagucgcucuaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggucgggcaucaucaucuccgacacccccgugcacgacugcaacacgaccugccagaccccgaagggcgccaucaacaccagccuccccuuccagaacauccaccccaucacgaucgggaagugccccaaguacgugaaguccaccaagcugcggcuggcgaccggccuccgcaacgucccgucgauccagucccgggggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacucggucaucgagaagaugaacacccaguucaccgccgugggcaaggaguucaaccaccucgagaagcgcaucgagaaccugaacaagaaggucgacgacggcuucauggacaucuggacguacaacgccgagcugcucgugcugcuggagaacgagcggacccucgacuaccacgacuccaacgugaagaaccuguacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcucaaccgggaggagaucgacggcgugaagcuggaguccacccgcaucuaccagauccuggcgaucuacagcaccgucgccucgucccucgugcugguggucagccugggggccaucuccuucuggaugugcagcaacggcucccuccagugccggaucugcaucuga

SEQ ID NO: 3696 - RNA, 1701 nt, Artificial Sequence; identical to SEQ ID NO: 116
  derived and/or modified CDS sequence (AUadapt) from InfluenzaA__ACX31962__HA

SEQ ID NO: 3697 - RNA, 1701 nt, Artificial Sequence; identical to SEQ ID NO: 116
  derived and/or modified CDS sequence (AUadapt) from InfluenzaA__ACX31964__HA

SEQ ID NO: 3698 - RNA, 1701 nt, Artificial Sequence; identical to SEQ ID NO: 62
  derived and/or modified CDS sequence (AUadapt) from InfluenzaA__ACX35237__HA

SEQ ID NO: 3699 - RNA, 1701 nt, Artificial Sequence; identical to SEQ ID NO: 116
  derived and/or modified CDS sequence (AUadapt) from InfluenzaA__ACX35247__HA

SEQ ID NO: 3700 - RNA, 1701 nt, Artificial Sequence; identical to SEQ ID NO: 116
  derived and/or modified CDS sequence (AUadapt) from InfluenzaA__ACX35257__HA

SEQ ID NO: 3701 - RNA, 1701 nt, Artificial Sequence; identical to SEQ ID NO: 116
  derived and/or modified CDS sequence (AUadapt) from InfluenzaA__ACX35267__HA

SEQ ID NO: 3702 - RNA, 1701 nt, Artificial Sequence; identical to SEQ ID NO: 116
  derived and/or modified CDS sequence (AUadapt) from InfluenzaA__ACX35277__HA

SEQ ID NO: 3703 - RNA, 1701 nt, Artificial Sequence; identical to SEQ ID NO: 116
  derived and/or modified CDS sequence (AUadapt) from InfluenzaA__ACX35287__HA

SEQ ID NO: 3704 - RNA, 1701 nt, Artificial Sequence; identical to SEQ ID NO: 116
  derived and/or modified CDS sequence (AUadapt) from InfluenzaA__ACX35297__HA

SEQ ID NO: 3705 - RNA, 1701 nt, Artificial Sequence
  derived and/or modified CDS sequence (AUadapt) from InfluenzaA__ACX35307__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggggcccggcgacaagaucaccuucgaggcgaccgggaaccucguggucccccgguacgccuucgccauggagcgcaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagucgaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcucgagagcacccgcaucuaccagauccuggcgaucuacuccaccgucgccucgagccuggugcucguggucucccugggcgccaucucguucuggaugugcuccaacggcagccugcagugccggaucugcaucuga

SEQ ID NO: 3706 - RNA, 1701 nt, Artificial Sequence; identical to SEQ ID NO: 3156
  derived and/or modified CDS sequence (AUadapt) from InfluenzaA__ACX35317__HA

SEQ ID NO: 3707 - RNA, 1701 nt, Artificial Sequence
  derived and/or modified CDS sequence (AUadapt) from InfluenzaA__ACX35327__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacuccuacguguucgugggcacgagccgguacuccaagaaguucaagcccgagaucgccauccgcccgaagguccgggaccaggagggccgcaugaacuacuacuggacccugguggagcccggggacaagaucaccuucgaggccaccggcaaccucguggucccccgguacgcguucgccauggagcgcaacgccgggucgggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgccaccggccugcgcaacgucccgucgauccagucccgggggcuguucggcgcgaucgccggguucaucgagggcggcuggacggggaugguggacggcugguacggguaccaccaccagaacgagcagggcagcggguacgccgccgaccucaaguccacccagaacgccaucgacgagaucaccaacaaggugaacucggucaucgagaagaugaacacccaguucacggcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggccaucuacagcaccgucgcgucgucccuggugcucguggucagccugggggccaucuccuucuggaugugcagcaacggcucccugcagugccggaucugcaucuga

SEQ ID NO: 3708 - RNA, 1701 nt, Artificial Sequence
  derived and/or modified CDS sequence (AUadapt) from InfluenzaA__ACX36501__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagcaucuaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucgccauggagcgcaacgccggguccggcaucaucaucagcgacacgcccgugcacgacugcaacacgaccugccagaccccgaagggcgccaucaacaccucccuccccuuccagaacauccaccccaucaccaucgggaagugccccaaguacgucaagucgaccaagcugcggcuggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcuggagagcacccgcaucuaccagauccucgcgaucuacuccaccgucgccucgagccuggugcugguggucucccucggggccaucucguucuggaugugcuccaacggcagccugcagugccggaucugcaucuga

SEQ ID NO: 3709 - RNA, 1701 nt, Artificial Sequence
  derived and/or modified CDS sequence (AUadapt) from InfluenzaA__ACX36502__HA
augaaggccauccuggugguccuccuguacaccuucgccaccgcgaacgccgacacgcugugcaucggcuaccacgccaacaacucgaccgacaccguggacaccauccucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagucgcuguccaccgccagcuccuggucguacaucgucgagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggugaccgccgccugcccgcacgccggcgcgaaguccuucuacaagaaccugaucuggcucgucaagaaggggaacucguaccccaagcuguccaagagcuacaucaacgacaagggcaaggaggugcuggugcucugggggauccaccaccccucgaccuccgccgaccagcagagcaucuaccagaacgccgacgccuacgucuucgugggcacgucccgguacucgaagaaguucaagcccgagaucgccauccgcccgaaggugcgggaccaggagggccgcaugaacuacuacuggacccuggucgagcccggggacaagaucaccuucgaggcgaccggcaaccugguggugccccgguacgccuucgccauggagcgcaacgccggguccggcaucaucaucagcgacacgcccguccacgacugcaacacgaccugccagaccccgaagggcgccaucaacaccucccuccccuuccagaacauccaccccaucaccaucgggaagugccccaaguacgucaagucgaccaagcugcggcuggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccuggacaucuggaccuacaacgccgagcuccugguccugcucgagaacgagcggacccuggacuaccacgacagcaacgugaagaaccuguacgagaaggugcgcucccagcucaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcuggagagcacccgcaucuaccagauccucgcgaucuacuccaccguggccucgagccugguccugguggugucccucggggccaucucguucuggaugugcuccaacggcagccugcagugccggaucugcaucuga

SEQ ID NO: 3710 - RNA, 1701 nt, Artificial Sequence
  derived and/or modified CDS sequence (AUadapt) from InfluenzaA__ACX36503__HA
augaaggccauccuggugguccuccuguacaccuucgccaccgcgaacgccgacacgcugugcaucggcuaccacgccaacaacucgaccgacaccguggacaccauccucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagucgcuguccaccgccagcuccuggucguacaucgucgagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggugaccgccgccugcccgcacgccggcgcgaaguccuucuacaagaaccugaucuggcucgucaagaaggggaacucguaccccaagcuguccaagagcuacaucaacgacaagggcaaggaggugcuggugcucugggggauccaccaccccucgaccuccgccgaccagcagagcaucuaccagaacgccgacgccuacgucuucgugggcacgucccgguacucgaagaaguucaagcccgagaucgccauccgcccgaaggugcgggaccaggagggccgcaugaacuacuacuggacccuggucgagcccggggacaagaucaccuucgaggcgaccggcaaccugguggugccccgguacgccuucgccauggagcgcaacgccggguccggcaucaucaucagcgacacgcccguccacgacugcaacacgaccugccagaccccgaagggcgccaucaacaccucccuccccuuccagaacauccaccccaucaccaucgggaagugccccaaguacgucaagucgaccaagcugcggcuggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccuggacaucuggaccuacaacgccgagcuccugguccugcucgagaacgagcggacccuggacuaccacgacagcaacgugaagaaccuguacgagaaggugcgcucccagcucaagaacaacaccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcuggagagcacccgcaucuaccagauccucgccaucuacuccaccguggcgucgagccugguccugguggugucccucggggccaucucguucuggaugugcuccaacggcagccugcagugccggaucugcaucuga

SEQ ID NO: 3711 - RNA, 1701 nt, Artificial Sequence
  derived and/or modified CDS sequence (AUadapt) from InfluenzaA__ACX47367__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacccgaacaagggggucaccgccgccugcccccacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacguguucgugggcacgucgcgguacuccaagaaguucaagccggagaucgccauccgccccaagguccgggaccaggagggccgcaugaacuacuacuggacccuggugaagcccggggacaagaucaccuucgaggcgaccggcaaccucguggucccccgguacgccuucgccauggagcgcaacgccgggagcggcaucaucaucuccgacacgccggugcacgacugcaacacgaccugccagacccccaagggcgccaucaacaccucgcugcccuuccagaacauccaccccaucaccaucgggaagugcccgaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcucgggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 3712 - RNA, 1701 nt, Artificial Sequence
  derived and/or modified CDS sequence (AUadapt) from InfluenzaA__ACX47368__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacccgaacaagggggucaccgccgccugcccccacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacguguucgugggcacgucgcgguacuccaagaaguucaagccggagaucgccauccgccccaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgccggugcacgacugcaacacgaccugccagacccccaagggcgccaucaacaccucgcugcccuuccagaacauccaccccaucaccaucgggaagugcccgaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcucgggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 3713 - RNA, 1701 nt, Artificial Sequence; identical to SEQ ID NO: 3712
  derived and/or modified CDS sequence (AUadapt) from InfluenzaA__ACX47369__HA

SEQ ID NO: 3714 - RNA, 1701 nt, Artificial Sequence
  derived and/or modified CDS sequence (AUadapt) from InfluenzaA__ACX47370__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacccgaacaagggggucaccgccgccugcccccacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucggccgaccggcagucccuguaccagaacgccgacgccuacguguucgugggcacgucgcgcuacuccaagaaguucaagccggagaucgccauccggcccaagguccgcgaccaggagggccggaugaacuacuacuggacccugguggagcccggggacaagaucaccuucgaggcgaccggcaaccucguggucccccgcuacgccuucgccauggagcggaacgccgggagcggcaucaucaucuccgacacgccggugcacgacugcaacacgaccugccagacccccaagggcgccaucaacaccucgcugcccuuccagaacauccaccccaucaccaucgggaagugcccgaaguacgugaaguccaccaagcugcgccucgcgaccggccugcggaacguccccagcauccagucccgcgggcuguucggcgccaucgccggguucaucgagggcggcuggacggggaugguggacggcugguacggguaccaccaccagaacgagcagggcucgggguacgccgccgaccucaaguccacccagaacgcgaucgacgagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaacgugaagaaccucuacgagaagguccggucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgugaagcucgaguccacccggaucuaccagauccuggcgaucuacucgaccgucgccuccagccuggugcucguggucucgcugggggccaucuccuucuggaugugcagcaacggcucccugcagugccgcaucugcaucuga

SEQ ID NO: 3715 - RNA, 1701 nt, Artificial Sequence; identical to SEQ ID NO: 3712
  derived and/or modified CDS sequence (AUadapt) from InfluenzaA__ACX47371__HA

SEQ ID NO: 3716 - RNA, 1701 nt, Artificial Sequence; identical to SEQ ID NO: 3712
  derived and/or modified CDS sequence (AUadapt) from InfluenzaA__ACX47372__HA

SEQ ID NO: 3717 - RNA, 1701 nt, Artificial Sequence; identical to SEQ ID NO: 3712
  derived and/or modified CDS sequence (AUadapt) from InfluenzaA__ACX47373__HA

SEQ ID NO: 3718 - RNA, 1701 nt, Artificial Sequence; identical to SEQ ID NO: 3712
  derived and/or modified CDS sequence (AUadapt) from InfluenzaA__ACX47374__HA

SEQ ID NO: 3719 - RNA, 1701 nt, Artificial Sequence
  derived and/or modified CDS sequence (AUadapt) from InfluenzaA__ACX47375__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacccgaacaagggggucaccgccgccugcccccacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacguguucgugggcacgucgcgguacuccaagaaguucaagccggagaucgccauccgccccaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgccggugcacgacugcaacacgaccugccagacccccaacggcgccaucaacaccucgcugcccuuccagaacauccaccccaucaccaucgggaagugcccgaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcucgggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 3720 - RNA, 1701 nt, Artificial Sequence; identical to SEQ ID NO: 3712
  derived and/or modified CDS sequence (AUadapt) from InfluenzaA__ACX47376__HA

SEQ ID NO: 3721 - RNA, 1701 nt, Artificial Sequence; identical to SEQ ID NO: 3712
  derived and/or modified CDS sequence (AUadapt) from InfluenzaA__ACX47377__HA

SEQ ID NO: 3722 - RNA, 1701 nt, Artificial Sequence
  derived and/or modified CDS sequence (AUadapt) from InfluenzaA__ACX47380__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccaccucguccuggagcuacaucguggagacguccucguccgacaacgggaccugcuaccccggcgacuucaucgacuacgaggagcuccgggagcagcugagcuccgugucguccuucgagcgcuucgagaucuuccccaagaccagcuccuggcccaaccacgacucgaacaagggcgucaccgccgccugcccgcacgccggcgccaaguccuucuacaagaaccugaucuggcucgugaagaaggggaacagcuaccccaagcuguccaagucguacaucaacgacaagggcaaggaggugcugguccucugggggauccaccaccccagcacguccgcggaccagcagucgcuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgugauggagcgcaacgccggguccggcaucaucaucucggacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagucgcgggggcuguucggcgccaucgcgggguucaucgagggcggcuggaccgggaugguggacggcugguacggguaccaccaccagaacgagcagggcuccggguacgccgccgaccucaagagcacccagaacgccaucgacgagaucaccaacaaggucaacuccgugaucgagaagaugaacacgcaguucaccgccgucggcaaggaguucaaccaccuggagaagcgcaucgagaaccugaacaagaagguggacgacggcuuccucgacaucuggaccuacaacgcggagcugcuggugcuccuggagaacgagcggacccuggacuaccacgacucgaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagucgacccgcaucuaccagauccuggccaucuacuccaccguggccagcucgcuggugcucgucgugucccugggggcgaucagcuucuggaugugcuccaacggcagccugcagugccggaucugcaucuga

SEQ ID NO: 3723 - RNA, 1701 nt, Artificial Sequence; identical to SEQ ID NO: 3722
  derived and/or modified CDS sequence (AUadapt) from InfluenzaA__ACX47381__HA

SEQ ID NO: 3724 - RNA, 1701 nt, Artificial Sequence; identical to SEQ ID NO: 3722
  derived and/or modified CDS sequence (AUadapt) from InfluenzaA__ACX47382__HA

SEQ ID NO: 3725 - RNA, 1701 nt, Artificial Sequence
  derived and/or modified CDS sequence (AUadapt) from InfluenzaA__ACX47383__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccaccagcuccuggucguacaucguggagacguccagcuccgacaacgggaccugcuaccccggcgacuucaucgacuacgaggagcuccgggagcagcugucguccgugagcuccuucgagcgcuucgagaucuuccccaagaccucguccuggcccaaccacgacagcaacaagggcgucaccgccgccugcccgcacgccggcgccaaguccuucuacaagaaccugaucuggcucgugaagaaggggaacucguaccccaagcuguccaagagcuacaucaacgacaagggcaaggaggugcugguccucugggggauccaccaccccucgacguccgcggaccagcagagccuguaccagaacgccgacgccuacguguucgugggcaccucccgguacucgaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggagaagaucgacggcgugaagcucgagagcacccgcaucuaccagauccuggccaucuacuccaccgucgcgucgagccuggugcucguggucucccugggggccaucucguucuggaugugcuccaacggcagccugcagugccggaucugcaucuga

SEQ ID NO: 3726 - RNA, 1701 nt, Artificial Sequence
  derived and/or modified CDS sequence (AUadapt) from InfluenzaA__ACX47384__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccaccagcuccuggucguacaucguggagacguccagcuccgacaacgggaccugcuaccccggcgacuucaucgacuacgaggagcuccgggagcagcugucguccgugagcuccuucgagcgcuucgagaucuuccccaagaccucguccuggcccaaccacgacagcaacaagggcgucaccgccgccugcccgcacgccggcgccaaguccuucuacaagaaccugaucuggcucgugaagaaggggaacucguaccccaagcuguccaagagcuacaucaacgacaagggcaaggaggugcugguccucugggggauccaccaccccucgacguccgcggaccagcagagccuguaccagaacgccgacgccuacguguucgugggcaccucccgguacucgaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggccaucuacuccaccgucgcgucgagccuggugcucguggucucccugggggccaucucguucuggaugugcuccaacggcagccugcagugccggaucugcaucuga

SEQ ID NO: 3727 - RNA, 1701 nt, Artificial Sequence; identical to SEQ ID NO: 3726
  derived and/or modified CDS sequence (AUadapt) from InfluenzaA__ACX47385__HA

SEQ ID NO: 3728 - RNA, 1701 nt, Artificial Sequence; identical to SEQ ID NO: 3726
  derived and/or modified CDS sequence (AUadapt) from InfluenzaA__ACX47387__HA

SEQ ID NO: 3729 - RNA, 1701 nt, Artificial Sequence; identical to SEQ ID NO: 116
  derived and/or modified CDS sequence (AUadapt) from InfluenzaA__ACX55834__HA

SEQ ID NO: 3730 - RNA, 1701 nt, Artificial Sequence; identical to SEQ ID NO: 3712
  derived and/or modified CDS sequence (AUadapt) from InfluenzaA__ACX61574__HA

SEQ ID NO: 3731 - RNA, 1701 nt, Artificial Sequence; identical to SEQ ID NO: 116
  derived and/or modified CDS sequence (AUadapt) from InfluenzaA__ACX61575__HA

SEQ ID NO: 3732 - RNA, 1701 nt, Artificial Sequence
  derived and/or modified CDS sequence (AUadapt) from InfluenzaA__ACX83577__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagcuucuccaccucguccagcugguccuacaucguggagaccucguccagcgacaacggcacgugcuaccccggcgacuucaucgacuacgaggagcugcgggagcagcucuccucgguguccagcuucgagcgcuucgagaucuuccccaagaccuccagcuggcccaaccacgacuccaacaagggggucaccgccgccugcccgcacgccggcgccaagucguucuacaagaaccugaucuggcuggugaagaaggggaacuccuaccccaagcucagcaagucguacaucaacgacaagggcaaggaggugcugguccugugggggauccaccaccccuccaccagcgcggaccagcagucccucuaccagaacgccgacgccuacguguucgugggcacgucgcgguacuccaagaaguucaagcccgagaucgccauccgcccgaagguccggggccaggaggggcgcaugaacuacuacuggacccugguggagcccggcgacaagaucaccuucgaggccaccgggaaccugguggucccccgguacgcguucgccauggagcgcaacgccggcagcggcaucaucaucuccgacacgcccgugcacgacugcaacacgaccugccagaccccgaagggggccaucaacaccucgcuccccuuccagaacauccaccccaucaccaucggcaagugccccaaguacgugaaguccaccaagcugcggcuggccaccgggcuccgcaacgucccgagcauccagucccggggccuguucggggcgaucgccggcuucaucgagggcggguggacgggcaugguggacgggugguacggcuaccaccaccagaacgagcaggggagcggcuacgccgccgaccugaaguccacccagaacgccaucgacgagaucaccaacaaggugaacucggucaucgagaagaugaacacccaguucacggcggugggcaaggaguucaaccaccucgagaagcgcaucgagaaccugaacaagaaggucgacgacggguuccuggacaucuggaccuacaacgccgagcuccuggugcugcucgagaacgagcggacccuggacuaccacgacuccaacgugaagaaccuguacgagaagguccgcagccagcucaagaacaacgccaaggagaucggcaacgggugcuucgaguucuaccacaagugcgacaacacgugcauggaguccgugaagaacggcaccuacgacuaccccaaguacucggaggaggccaagcugaaccgggaggagaucgacggggugaagcuggaguccacccgcaucuaccagauccucgccaucuacagcaccgucgcgucgucccuggugcugguggucagccucggcgccaucuccuucuggaugugcagcaacggcucccugcagugccggaucugcaucuga

SEQ ID NO: 3733 - RNA, 1701 nt, Artificial Sequence
  derived and/or modified CDS sequence (AUadapt) from InfluenzaA__ACX94091__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccaucagcuggcccaaccacgacuccaacaagggggucaccgccgccugcccgcacgccggcgccaagucguucuacaagaaccugaucuggcucgugaagaaggggaacuccuaccccaagcugagcaaguccuacaucaacgacaagggcaaggaggugcugguccucugggggauccaccaccccucgaccagcgccgaccagcagucccuguaccagaacgccgacgccuacguguucgugggcacgucgcgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccucgcugcccuuccagaacauccaccccaucaccaucgggaagugcuccaaguacgucaagagcaccaagcugcggcucgcgaccggccugcgcaacgugcccuccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacacgugcauggagagcgugaagaacgggaccuacgacuacccgaaguacuccgaggaggccaagcugaaccgggaggagaucgacggcgugaagcucgagucgacccgcaucuaccagauccuggcgaucuacuccaccgucgccagcucgcuggugcucguggucucccugggggccaucagcuucuggaugugcuccaacggcagccugcagugccggaucugcaucuga

SEQ ID NO: 3734 - RNA, 1701 nt, Artificial Sequence
  derived and/or modified CDS sequence (AUadapt) from InfluenzaA__ACY26192__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacaacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccaggacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 3735 - RNA, 1701 nt, Artificial Sequence; identical to SEQ ID NO: 3483
  derived and/or modified CDS sequence (AUadapt) from InfluenzaA__ACY26202__HA

SEQ ID NO: 3736 - RNA, 1701 nt, Artificial Sequence; identical to SEQ ID NO: 116
  derived and/or modified CDS sequence (AUadapt) from InfluenzaA__ACY46103__HA

SEQ ID NO: 3737 - RNA, 1701 nt, Artificial Sequence; identical to SEQ ID NO: 116
  derived and/or modified CDS sequence (AUadapt) from InfluenzaA__ACY46113__HA

SEQ ID NO: 3738 - RNA, 1701 nt, Artificial Sequence
  derived and/or modified CDS sequence (AUadapt) from InfluenzaA__ACY46123__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaaggucggcgaccaggaggggcggaugaacuacuacuggacccugguggagcccggcgacaagaucaccuucgaggcgaccgggaaccucguggucccccgcuacgccuucgccauggagcggaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagucgaccaagcugcgccucgcgaccgggcugcggaacgugccguccauccagagccgcggccuguucggggccaucgccggcuucaucgagggcggguggacgggcaugguggacgggugguacggcuaccaccaccagaacgagcagggguccggcuacgccgccgaccucaagucgacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggguuccucgacaucuggaccuacaacgccgagcugcuggugcuccuggagaacgagcgcacccuggacuaccacgacagcaacgugaagaaccucuacgagaagguccggucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgcgaggagaucgacggggugaagcucgagagcacccggaucuaccagauccuggcgaucuacuccaccgucgccucgagccuggugcucguggucucccugggcgccaucucguucuggaugugcuccaacggcagccugcagugccgcaucugcaucuga

SEQ ID NO: 3739 - RNA, 1701 nt, Artificial Sequence; identical to SEQ ID NO: 116
  derived and/or modified CDS sequence (AUadapt) from InfluenzaA__ACY46133__HA

SEQ ID NO: 3740 - RNA, 1701 nt, Artificial Sequence; identical to SEQ ID NO: 116
  derived and/or modified CDS sequence (AUadapt) from InfluenzaA__ACY46163__HA

SEQ ID NO: 3741 - RNA, 1701 nt, Artificial Sequence
  derived and/or modified CDS sequence (AUadapt) from InfluenzaA__ACY46173__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagcaaguacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggucgggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgucgauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgcgaggagaucgacggcgugaagcucgaguccacccggaucuaccagauccuggcgaucuacagcaccgucgccucgucccuggugcucguggucagccugggggccaucuccuucuggaugugcagcaacggcucccugcagugccgcaucugcaucuga

SEQ ID NO: 3742 - RNA, 1701 nt, Artificial Sequence; identical to SEQ ID NO: 116
  derived and/or modified CDS sequence (AUadapt) from InfluenzaA__ACY46213__HA

SEQ ID NO: 3743 - RNA, 1701 nt, Artificial Sequence; identical to SEQ ID NO: 116
  derived and/or modified CDS sequence (AUadapt) from InfluenzaA__ACY46223__HA

SEQ ID NO: 3744 - RNA, 1701 nt, Artificial Sequence; identical to SEQ ID NO: 116
  derived and/or modified CDS sequence (AUadapt) from InfluenzaA__ACY46233__HA

SEQ ID NO: 3745 - RNA, 1701 nt, Artificial Sequence; identical to SEQ ID NO: 116
  derived and/or modified CDS sequence (AUadapt) from InfluenzaA__ACY46243__HA

SEQ ID NO: 3746 - RNA, 1701 nt, Artificial Sequence; identical to SEQ ID NO: 116
  derived and/or modified CDS sequence (AUadapt) from InfluenzaA__ACY46253__HA

SEQ ID NO: 3747 - RNA, 1701 nt, Artificial Sequence; identical to SEQ ID NO: 116
  derived and/or modified CDS sequence (AUadapt) from InfluenzaA__ACY46263__HA

SEQ ID NO: 3748 - RNA, 1701 nt, Artificial Sequence; identical to SEQ ID NO: 116
  derived and/or modified CDS sequence (AUadapt) from InfluenzaA__ACY46273__HA

SEQ ID NO: 3749 - RNA, 1701 nt, Artificial Sequence; identical to SEQ ID NO: 116
  derived and/or modified CDS sequence (AUadapt) from InfluenzaA__ACY46283__HA

SEQ ID NO: 3750 - RNA, 1701 nt, Artificial Sequence
  derived and/or modified CDS sequence (AUadapt) from InfluenzaA__ACY46293__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcggccggccugcgcaacgugccguccauccagagccgggggcuguucggcgccaucgccggguucaucgagggcggcuggaccgggaugguggacggcugguacggguaccaccaccagaacgagcagggcuccggguacgccgcggaccucaagucgacgcagaacgccaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggcgaagcugaaccgggaggagaucgacggcgugaagcucgagagcacccgcaucuaccagauccuggccaucuacuccaccgucgccucgagccuggugcucguggucucccugggggccaucucguucuggaugugcuccaacggcagccugcagugccggaucugcaucuga

SEQ ID NO: 3751 - RNA, 1701 nt, Artificial Sequence; identical to SEQ ID NO: 116
  derived and/or modified CDS sequence (AUadapt) from InfluenzaA__ACY46303__HA

SEQ ID NO: 3752 - RNA, 1701 nt, Artificial Sequence; identical to SEQ ID NO: 116
  derived and/or modified CDS sequence (AUadapt) from InfluenzaA__ACY46313__HA

SEQ ID NO: 3753 - RNA, 1701 nt, Artificial Sequence; identical to SEQ ID NO: 116
  derived and/or modified CDS sequence (AUadapt) from InfluenzaA__ACY46323__HA

SEQ ID NO: 3754 - RNA, 1701 nt, Artificial Sequence; identical to SEQ ID NO: 116
  derived and/or modified CDS sequence (AUadapt) from InfluenzaA__ACY46343__HA

SEQ ID NO: 3755 - RNA, 1701 nt, Artificial Sequence; identical to SEQ ID NO: 116
  derived and/or modified CDS sequence (AUadapt) from InfluenzaA__ACY46353__HA

SEQ ID NO: 3756 - RNA, 1701 nt, Artificial Sequence
  derived and/or modified CDS sequence (AUadapt) from InfluenzaA__ACY46373__HA
augaaggccauccugaucgugcuccuguacaccuucgccaccgcgaacgccgacacgcugugcaucggcuaccacgccaacaacucgaccgacaccgucgacaccgugcucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagucgcuguccaccgccagcuccuggucguacaucgucgagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggugaccgccgccugcccgcacgccggcgcgaaguccuucuacaagaaccugaucuggcucgucaagaaggggaacucguaccccaagcuguccaagagcuacaucaacgacaagggcaaggaggugcuggugcucugggggauccaccaccccucgaccuccgccgaccagcagagccuguaccagaacgccgacgccuacgucuucgugggcacgucccgguacucgaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgagccugguccucguggugucccugggggccaucucguucuggaugugcuccaacggcagccugcagugccggaucugcaucuga

SEQ ID NO: 3757 - RNA, 1701 nt, Artificial Sequence
  derived and/or modified CDS sequence (AUadapt) from InfluenzaA__ACY46383__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccacaacauccaccccaucacgaucgggaagugccccaaguacgugaaguccaccaagcugcggcucgcgaccggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 3758 - RNA, 1701 nt, Artificial Sequence; identical to SEQ ID NO: 116
  derived and/or modified CDS sequence (AUadapt) from InfluenzaA__ACY46393__HA

SEQ ID NO: 3759 - RNA, 1701 nt, Artificial Sequence; identical to SEQ ID NO: 116
  derived and/or modified CDS sequence (AUadapt) from InfluenzaA__ACY46403__HA

SEQ ID NO: 3760 - RNA, 1701 nt, Artificial Sequence; identical to SEQ ID NO: 116
  derived and/or modified CDS sequence (AUadapt) from InfluenzaA__ACY46413__HA

SEQ ID NO: 3761 - RNA, 1701 nt, Artificial Sequence; identical to SEQ ID NO: 116
  derived and/or modified CDS sequence (AUadapt) from InfluenzaA__ACY46433__HA

SEQ ID NO: 3762 - RNA, 1701 nt, Artificial Sequence; identical to SEQ ID NO: 116
  derived and/or modified CDS sequence (AUadapt) from InfluenzaA__ACY46443__HA

SEQ ID NO: 3763 - RNA, 1701 nt, Artificial Sequence; identical to SEQ ID NO: 116
  derived and/or modified CDS sequence (AUadapt) from InfluenzaA__ACY46453__HA

SEQ ID NO: 3764 - RNA, 1701 nt, Artificial Sequence
  derived and/or modified CDS sequence (AUadapt) from InfluenzaA__ACY46463__HA
augaaggccauccugguggucaugcucuacaccuucgccaccgcgaacgccgacacgcugugcaucggcuaccacgccaacaacucgaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagagccuguccaccgccucguccuggagcuacaucguggagaccuccucguccgacaacggcacgugcuaccccggcgacuucaucgacuacgaggagcugcgggagcagcucagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcuggugaagaaggggaacagcuaccccaagcucuccaagucguacaucaacgacaagggcaaggaggugcugguccugugggggauccaccaccccagcaccuccgccgaccagcagucgcucuaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucgccauggugcgcaacgccggguccggcaucaucaucucggacacgcccgugcacgacugcaacacgaccugccagaccccgaagggcgccaucaacaccucccuccccuuccagaacauccaccccaucaccaucgggaagugccccaaguacgucaagagcaccaagcugcggcuggcgaccggccuccgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggucaacuccgugaucgagaagaugaacacccaguucacggccgucggcaaggaguucaaccaccuggagaagcgcaucgagaaccugaacaagaagguggacgacggcuuccuggacaucuggaccuacaacgccgagcuccuggugcugcucgagaacgagcggacccuggacuaccacgacucgaacgucaagaaccuguacgagaaggugcgcucccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcuggagucgacccgcaucuaccagauccucgcgaucuacuccaccguggccagcucgcuggugcuggucgugucccucggggccaucagcuucuggaugugcuccaacggcagccugcagugccggaucugcaucuga

SEQ ID NO: 3765 - RNA, 1701 nt, Artificial Sequence; identical to SEQ ID NO: 116
  derived and/or modified CDS sequence (AUadapt) from InfluenzaA__ACY46473__HA

SEQ ID NO: 3766 - RNA, 1701 nt, Artificial Sequence; identical to SEQ ID NO: 62
  derived and/or modified CDS sequence (AUadapt) from InfluenzaA__ACY46493__HA

SEQ ID NO: 3767 - RNA, 1701 nt, Artificial Sequence
  derived and/or modified CDS sequence (AUadapt) from InfluenzaA__ACY46513__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagcaaguacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggucgggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgucgauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggacaacgagcgcacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgcgaggagaucgacggcgugaagcucgaguccacccggaucuaccagauccuggcgaucuacagcaccgucgccucgucccuggugcucguggucagccugggggccaucuccuucuggaugugcagcaacggcucccugcagugccgcaucugcaucuga

SEQ ID NO: 3768 - RNA, 1701 nt, Artificial Sequence; identical to SEQ ID NO: 116
  derived and/or modified CDS sequence (AUadapt) from InfluenzaA__ACY46523__HA

SEQ ID NO: 3769 - RNA, 1701 nt, Artificial Sequence; identical to SEQ ID NO: 116
  derived and/or modified CDS sequence (AUadapt) from InfluenzaA__ACY46533__HA

SEQ ID NO: 3770 - RNA, 1701 nt, Artificial Sequence; identical to SEQ ID NO: 116
  derived and/or modified CDS sequence (AUadapt) from InfluenzaA__ACY46562__HA

SEQ ID NO: 3771 - RNA, 1701 nt, Artificial Sequence; identical to SEQ ID NO: 116
  derived and/or modified CDS sequence (AUadapt) from InfluenzaA__ACY46572__HA

SEQ ID NO: 3772 - RNA, 1701 nt, Artificial Sequence; identical to SEQ ID NO: 116
  derived and/or modified CDS sequence (AUadapt) from InfluenzaA__ACY46582__HA

SEQ ID NO: 3773 - RNA, 1701 nt, Artificial Sequence; identical to SEQ ID NO: 116
  derived and/or modified CDS sequence (AUadapt) from InfluenzaA__ACY46592__HA

SEQ ID NO: 3774 - RNA, 1701 nt, Artificial Sequence; identical to SEQ ID NO: 116
  derived and/or modified CDS sequence (AUadapt) from InfluenzaA__ACY46622__HA

SEQ ID NO: 3775 - RNA, 1701 nt, Artificial Sequence
  derived and/or modified CDS sequence (AUadapt) from InfluenzaA__ACY46672__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggugcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggucaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacucgaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagucgacccgcaucuaccagauccuggcgaucuacuccaccguggccagcucgcuggugcucgucgugucccugggggccaucagcuucuggaugugcuccaacggcagccugcagugccggaucugcaucuga

SEQ ID NO: 3776 - RNA, 1701 nt, Artificial Sequence; identical to SEQ ID NO: 116
  derived and/or modified CDS sequence (AUadapt) from InfluenzaA__ACY46682__HA

SEQ ID NO: 3777 - RNA, 1701 nt, Artificial Sequence; identical to SEQ ID NO: 116
  derived and/or modified CDS sequence (AUadapt) from InfluenzaA__ACY46692__HA

SEQ ID NO: 3778 - RNA, 1701 nt, Artificial Sequence; identical to SEQ ID NO: 116
  derived and/or modified CDS sequence (AUadapt) from InfluenzaA__ACY46712__HA

SEQ ID NO: 3779 - RNA, 1701 nt, Artificial Sequence
  derived and/or modified CDS sequence (AUadapt) from InfluenzaA__ACY46722__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccggccagcagagccuguaccagaacgccgacgccuacguguucgugggcacgucccgguacucgaagaaguucaagcccgagaucgccauccgcccgaagguccgggaccaggaggggcgcaugaacuacuacuggacccugguggagcccggcgacaagaucaccuucgaggcgaccgggaaccucguggucccccgguacgccuucgccauggagcgcaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagucgaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcucgagagcacccgcaucuaccagauccuggcgaucuacuccaccgucgccucgagccuggugcucguggucucccugggcgccaucucguucuggaugugcuccaacggcagccugcagugccggaucugcaucuga

SEQ ID NO: 3780 - RNA, 1701 nt, Artificial Sequence
  derived and/or modified CDS sequence (AUadapt) from InfluenzaA__ACY46742__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcaacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 3781 - RNA, 1701 nt, Artificial Sequence; identical to SEQ ID NO: 116
  derived and/or modified CDS sequence (AUadapt) from InfluenzaA__ACY46762__HA

SEQ ID NO: 3782 - RNA, 1701 nt, Artificial Sequence; identical to SEQ ID NO: 116
  derived and/or modified CDS sequence (AUadapt) from InfluenzaA__ACY46772__HA

SEQ ID NO: 3783 - RNA, 1701 nt, Artificial Sequence; identical to SEQ ID NO: 116
  derived and/or modified CDS sequence (AUadapt) from InfluenzaA__ACY46903__HA

SEQ ID NO: 3784 - RNA, 1701 nt, Artificial Sequence; identical to SEQ ID NO: 2940
  derived and/or modified CDS sequence (AUadapt) from InfluenzaA__ACY77534__HA

SEQ ID NO: 3785 - RNA, 1698 nt, Artificial Sequence
  derived and/or modified CDS sequence (AUadapt) from InfluenzaA__ACY77544__HA
augaaggccauccugguggucaugcucuacaccuucgccaccgcgaacgccgacacgcugugcaucggcuaccacgccaacaacucgaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagagccuguccaccgccucguccuggagcuacaucguggagaccuccucguccgacaacggcacgugcuaccccggcgacuucaucgacuacgaggagcugcgggagcagcucagcuccgugucguccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacucguaccccaagcucuccaagagcuacaucaacgacaagggcaaggaggugcugguccugugggggauccaccaccccucgaccuccgccgaccagcagagccucuaccagaacgccgacgccuacguguucgugggcuccucgcgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggagcggcaucaucaucuccgacaccacggugcacgacugcaacacgaccugccagacccccaagggcgccaucaacaccucgcucccguuccagaacauccaccccaucaccaucgggaagugccccaaguacgugaaguccaccaagcugcggcuggcgaccggccuccgcaacguccccagcauccagucccgggggcuguucggcgccaucgccggguucaucgagggcggcuggacggggaugguggacggcugguacggguaccaccaccagaacgagcagggcagcggguacgccgccgaccugaaguccacccagaacgcgaucgacgagaucaccaacaaggugaacucggucaucgagaagaugaacacccaguucacggccgugggcaaggaguucaaccaccucgagaagcgcaucgagaaccugaacaagaaggucgacgacggcuuccuggacaucuggaccuacaacgccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuacccgaaguacucggaggaggccaagcugaaccgggaggagaucgacggcgugaagcuggaguccacccgcaucuaccagauccucgcgaucuacagcaccgucgccucgucccuggugcugguggucagccucggggccaucuccuucuggaugugcagcuggucccugcagugccggaucugcaucuga

SEQ ID NO: 3786 - RNA, 1698 nt, Artificial Sequence
  derived and/or modified CDS sequence (AUadapt) from InfluenzaA__ACY77554__HA
augaaggccauccuggugguccugcuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacaacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgacccgcaucuaccagauccuggcgaucuacuccaccgucgccagcucgcuggugcucguggucucccugggggccaucagcuucuggaugugcuccggccaccuccagugccggaucugcaucuga

SEQ ID NO: 3787 - RNA, 1695 nt, Artificial Sequence
  derived and/or modified CDS sequence (AUadapt) from InfluenzaA__ACY77573__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcuccucgcgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacgcagucggcgaucgacgagaucaccaacaaggugaacuccgucaucgagaagaugaacacccagcugaccggccagugcaaggaguucaaccaccuggagaagcgcaucgagaaccucaacaagaagguggacgacggcuuccuggacaucuggacguacaacgccgagcugcucguccugcuggagaacgagcggacccucgacuaccacgacagcaacgugaagaaccuguacgagaaggugcgcucccagcugaagaacaacgccaacgagaucgggaacggcugcuucgaguucuaccacaagugcgacaacacgugcauggagucggucaagaacgggaccuacgacuaccccaaguacuccgaggaggccaagcucaaccgggaggagaucgacggcgugaagcuggagagcacccgcaucuaccagauccuggccaucuacucgaccguggcguccagccucguccugguggugucccugggggccaucucguucuggaugugcuccggccacagcugccggaucugcaucuga

SEQ ID NO: 3788 - RNA, 1701 nt, Artificial Sequence
  derived and/or modified CDS sequence (AUadapt) from InfluenzaA__ACY77593__HA
augaaggccauccugguggucaugcucuacaccuucgccaccgcgaacgccgacacgcugugcaucggcuaccacgccaacaacucgaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagagccuguccaccgccucguccuggagcuacaucguggagaccuccucguccgacaacggcacgugcuaccccggcgacuucaucgacuacgaggagcugcgggagcagcucagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcuggugaagaaggggaacagcuaccccaagcucuccaagucguacaucaacgacaagggcaaggaggugcugguccugugggggauccaccaccccagcaccuccgccgaccagcagucgcucuaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggucgggcaucaucaucuccgacaccacggugcacgacugcaacacgaccugccagacccccaagggcgccaucaacaccagccucccguuccagaacauccaccccaucaccaucgggaagugccccaaguacgugaaguccaccaagcugcggcuggcgaccggccuccgcaacguccccucgauccagucccgggggcuguucggcgccaucgccggguucaucgagggcggcuggacggggaugguggacggcugguacggguaccaccaccagaacgagcagggcagcggguacgccgccgaccugaaguccacccagaacgcgaucgacgagaucaccaacaaggugaacucggucaucgagaagaugaacacccaguucacggccgugggcaaggaguucaaccaccucgagaagcgcaucgagaaccugaacaagaaggucgacgacggcuuccuggacaucuggaccuacaacgccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuacccgaaguacucggaggaggccaagcugaaccgggaggagaucgacggcgugaagcuggaguccacccgcaucuaccagauccucgcgaucuacagcaccgucgccucgucccuggugcugguggucagccucggggccaucuccuucuggaugugcagcaacggcucccugcagugccggaucugcaucuga

SEQ ID NO: 3789 - RNA, 1698 nt, Artificial Sequence
  derived and/or modified CDS sequence (AUadapt) from InfluenzaA__ACY77603__HA
augaaggccauccugguggucaugcucuacaccuucgccaccgcgaacgccgacacgcugugcaucggcuaccacgccaacaacucgaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagagccuguccaccgccucguccuggagcuacaucguggagaccuccucguccgacaacggcacgugcuaccccggcgacuucaucgacuacgaggagcugcgggagcagcucagcuccgugucguccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacucguaccccaagcucuccaagagcuacaucaacgacaagggcaaggaggugcugguccugugggggauccaccaccccucgaccuccgccgaccagcagagccucuaccagaacgccgacgccuacguguucgugggcuccucgcgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggagcggcaucaucaucuccgacacccccgugcacgacugcaacacgaccugccagaccccgaagggcgccaucaacaccucgcuccccuuccagaacauccaccccaucacgaucgggaagugccccaaguacgugaaguccaccaagcugcggcuggcgaccggccuccgcaacgucccgagcauccagucccgggggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacucggucaucgagaagaugaacacccaguucaccgccgugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcuggaguccacccgcaucuaccagauccucgcgaucuacagcaccgucgccucgucccuggugcugguggucagccucggggccaucuccuucuggaugugcagcuggucccugcagugccggaucugcaucuga

SEQ ID NO: 3790 - RNA, 1695 nt, Artificial Sequence
  derived and/or modified CDS sequence (AUadapt) from InfluenzaA__ACY77613__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacgggccagugcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggccaucuacuccaccguggcgucgagccugguccucguggugucccugggggccaucucguucuggaugugcuccggccacagcugccggaucugcaucuga

SEQ ID NO: 3791 - RNA, 1701 nt, Artificial Sequence; identical to SEQ ID NO: 116
  derived and/or modified CDS sequence (AUadapt) from InfluenzaA__ACY77623__HA

SEQ ID NO: 3792 - RNA, 1707 nt, Artificial Sequence
  derived and/or modified CDS sequence (AUadapt) from InfluenzaA__ACY77653__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccucguccuggagcuacaucguggagaccuccucguccgacaacggcacgugcuaccccggcgacuucaucgacuacgaggagcugcgggagcagcucagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcuggugaagaaggggaacagcuaccccaagcucuccaagucguacaucaacgacaagggcaaggaggugcugguccugugggggauccaccaccccagcaccuccgccgaccagcagagccucuaccagaacgccgacgccuacguguucgugggcuccucgcgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggagcggcaucaucaucuccgacacccccgugcacgacugcaacacgaccugccagaccccgaagggcgccaucaacaccucgcuccccuuccagaacauccaccccaucacgaucgggaagugccccaaguacgugaaguccaccaagcugcggcuggcgaccggccuccgcaacgucccgagcauccagucccgggggcuguucggcgccaucgccggguucaucgagggcggcuggaccgggaugguggacggcugguacggguaccaccaccagaacgagcagggcucgggguacgccgccgaccugaaguccacgcagaacgcgaucgacgagaucaccaacaaggugaacagcgucaucgagaagaugaacacccaguucaccgccgugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcucgcagcucaagaacaacgccaaggagguggggaacggcugcuucgaguucuaccacaagugcgacaacacgugcauggaguccgugaagaacgggaccuacgacuaccccaaguacagcgaggaggccaagcugaaccgggaggagaucgacggcgucaagcuggaguccacccgcaucuaccagauccucgcgaucuacucgaccguggccagcucccuggugcuggucgugucgcucggggccaucuccuucuggaugugcagcggccacuccggcagccugcagugccggaucugcaucuga

SEQ ID NO: 3793 - RNA, 1698 nt, Artificial Sequence
  derived and/or modified CDS sequence (AUadapt) from InfluenzaA__ACY77663__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgacccgcaucuaccagauccuggcgaucuacuccaccgucgccagcucgcuggugcucguggucucccugggggccaucagcuucuggaugugcuccuggagccugcucugccggaucugcaucuga

SEQ ID NO: 3794 - RNA, 1698 nt, Artificial Sequence
  derived and/or modified CDS sequence (AUadapt) from InfluenzaA__ACY77683__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccucguccuggagcuacaucguggagaccuccucguccgacaacggcacgugcuaccccggcgacuucaucgacuacgaggagcugcgggagcagcucagcuccgugucguccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacucguaccccaagcucuccaagagcuacaucaacgacaagggcaaggaggugcugguccugugggggauccaccaccccucgaccuccgccgaccagcagagccucuaccagaacgccgacgccuacguguucgugggcuccucgcgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggagcggcaucaucaucuccgacacccccgugcacgacugcaacacgaccugccagaccccgaagggcgccaucaacaccucgcuccccuuccagaacauccaccccaucacgaucgggaagugccccaaguacgugaaguccaccaagcugcggcuggcgaccggccuccgcaacgucccgagcauccagucccgggggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacucggucaucgagaagaugaacacccaguucaccgccgugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcagccagcucaagaacaacgccaaggagguggggaacggcugcuucgaguucuaccacaagugcgacaacacgugcauggaguccgugaagaacgggaccuacgacuaccccaaguacucggaggaggccaagcugaaccgggaggagaucgacggcgucaagcuggaguccacccgcaucuaccagauccucgcgaucuacagcaccguggccucgucccuggugcuggucgugagccucggggccaucuccuucuggaugugcagcuggucccugcagugccggaucugcaucuga

SEQ ID NO: 3795 - RNA, 1698 nt, Artificial Sequence
  derived and/or modified CDS sequence (AUadapt) from InfluenzaA__ACY77693__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccucguccuggagcuacaucguggagaccuccucguccgacaacggcacgugcuaccccggcgacuucaucgacuacgaggagcugcgggagcagcucagcuccgugucguccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacucguaccccaagcucuccaagagcuacaucaacgacaagggcaaggaggugcugguccugugggggauccaccaccccucgaccuccgccgaccagcagagccucuaccagaacgccgacgccuacguguucgugggcuccucgcgguacuccaagaaguucaagcccgagaucacgauccgcccgaagguccgggaccaggagggccgcaugaacuacuacuggacccugguggagcccggggacaagaucaccuucgaggccaccggcaaccugguggucccccgguacgcguucgccauggagcgcaacgccgggagcggcaucaucaucuccgacacgcccgugcacgacugcaacacgaccugccagaccccgaagggcgccaucaacaccucgcuccccuuccagaacauccaccccaucaccaucgggaagugccccaaguacgugaaguccaccaagcugcggcuggccaccggccuccgcaacgucccgagcauccagucccgggggcuguucggcgcgaucgccggguucaucgagggcggcuggacggggaugguggacggcugguacggguaccaccaccagaacgagcagggcagcggguacgccgccgaccugaaguccacccagaacgccaucgacgagaucaccaacaaggugaacucggucaucgagaagaugaacacccaguucacgggccagugcaaggaguucaaccaccucgagaagcgcaucgagaaccugaacaagaagguggacgacggcuuccuggacaucuggaccuacaacgcggagcuccugguccugcucgagaacgagcggacccuggacuaccacgacuccaacgugaagaaccuguacgagaaggugcgcagccagcucaagaacaacgccaaggaggucgggaacggcugcuucgaguucuaccacaagugcgacaacacgugcauggaguccgugaagaacgggaccuacgacuaccccaaguacucggaggaggccaagcugaaccgggaggagaucgacggcgugaagcuggaguccacccgcaucuaccagauccucgccaucuacagcaccgucgccucgucccuggugcugguggucagccucggggcgaucuccuucuggaugugcagcuggucccugcagugccggaucugcaucuga

SEQ ID NO: 3796 - RNA, 1698 nt, Artificial Sequence
  derived and/or modified CDS sequence (AUadapt) from InfluenzaA__ACY77703__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccucguccuggagcuacaucguggagaccuccucguccgacaacggcacgugcuaccccggcgacuucaucgacuacgaggagcugcgggagcagcucagcuccgugucguccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacucguaccccaagcucuccaagagcuacaucaacgacaagggcaaggaggugcugguccugugggggauccaccaccccucgaccuccgccgaccagcagagccucuaccagaacgccgacgccuacguguucgugggcuccucgcgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggagcggcaucaucaucuccgacacccccgugcacgacugcaacacgaccugccagaccccgaagggcgccaucaacaccucgcuccccuuccagaacauccaccccaucacgaucgggaagugccccaaguacgugaaguccaccaagcugcggcuggcgaccggccuccgcaacgucccgagcauccagucccgggggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacucggucaucgagaagaugaacacccaguucaccggccagugcaaggaguucaaccaccucgagaagcgcaucgagaaccugaacaagaagguggacgacggcuuccuggacaucuggacguacaacgccgagcuccugguccugcucgagaacgagcggacccuggacuaccacgacuccaacgugaagaaccuguacgagaaggugcgcagccagcucaagaacaacgccaaggaggucgggaacggcugcuucgaguucuaccacaagugcgacaacacgugcauggaguccgugaagaacgggaccuacgacuaccccaaguacucggaggaggccaagcugaaccgggaggagaucgacggcgugaagcuggaguccacccgcaucuaccagauccucgccaucuacagcaccgucgcgucgucccuggugcugguggucagccucggggccaucuccuucuggaugugcagcuggucccugcagugccggaucugcaucuga

SEQ ID NO: 3797 - RNA, 1698 nt, Artificial Sequence
  derived and/or modified CDS sequence (AUadapt) from InfluenzaA__ACY77713__HA
augaaggccauccuggugguccugcuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccagcuccgacaacggcacgugcuaccccggcgacuucaucgacuacgaggagcugcgggagcagcucucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcuggugaagaaggggaacucguaccccaagcucuccaagagcuacaucaacgacaagggcaaggaggugcugguccugugggggauccaccaccccucgaccuccgccgaccagcagagccucuaccagaacgccgacgccuacguguucgugggcuccucgcgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggagcggcaucaucaucuccgacacccccgugcacgacugcaacacgaccugccagaccccgaagggcgccaucaacaccucgcuccccuuccagaacauccaccccaucacgaucgggaagugccccaaguacgugaaguccaccaagcugcggcuggcgaccggccuccgcaacgucccgagcauccagucccgggggcuguucggcgccaucgccggguucaucgagggcggcuggaccgggaugguggacggcugguacggguaccaccaccagaacgagcagggcucgggguacgccgccgaccugaaguccacgcagaacgcgaucgacgagaucaccaacaaggugaacagcgucaucgagaagaugaacacccaguucaccggccagugcaaggaguucaaccaccucgagaagcgcaucgagaaccugaacaagaagguggacgacggcuuccuggacaucuggacguacaacgccgagcuccugguccugcucgagaacgagcggacccuggacuaccacgacuccaacgugaagaaccuguacgagaaggugcgcucgcagcucaagaacaacgccaaggaggucgggaacggcugcuucgaguucuaccacaagugcgacaacacgugcauggaguccgugaagaacgggaccuacgacuaccccaaguacagcgaggaggccaagcugaaccgggaggagaucgacggcgugaagcuggaguccacccgcaucuaccagauccucgccaucuacucgaccgucgcgagcucccuggugcugguggucucgcucggggccaucuccuucuggaugugcagcggccaccuccagugccggaucugcaucuga

SEQ ID NO: 3798 - RNA, 1701 nt, Artificial Sequence; identical to SEQ ID NO: 3227
  derived and/or modified CDS sequence (AUadapt) from InfluenzaA__ACY77723__HA

SEQ ID NO: 3799 - RNA, 1695 nt, Artificial Sequence
  derived and/or modified CDS sequence (AUadapt) from InfluenzaA__ACY77733__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccagcuccgacaacggcacgugcuaccccggcgacuucaucgacuacgaggagcugcgggagcagcucucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcuggugaagaccgggaacucguaccccaagcucuccaagagcuacaucaacgacaagggcaaggaggugcugguccugugggggauccaccaccccucgacguccgccgaccagcagagccucuaccagaacgccgacgccuacguguucgugggcuccucgcgguacuccaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucgccauggagcgcaacgccgggagcggcaucaucaucuccgacacgcccgugcacgacugcaacacgaccugccagaccccgaagggcgccaucaacaccucgcuccccuuccagaacauccaccccaucaccaucgggaagugccccaaguacgugaaguccaccaagcugcggcuggcgaccggccuccgcaacgucccgagcauccagucccgggggcuguucggcgccaucgccggguucaucgagggcggcuggacggggaugguggacggcugguacggguaccaccaccagaacgagcagggcucgggguacgccgccgaccugaaguccacccagaacgcgaucgacgagaucaccaacaaggugaacagcgucaucgagaagaugaacacccaguucacggccgugggcaaggaguucaaccaccucgagaagcgcaucgagaaccugaacaagaaggucgacgacggcuuccuggacaucuggaccuacaacgccgagcuccuggugcugcucgagaacgagcggacccuggacuaccacgacuccaacgugaagaaccuguacgagaagguccgcucgcagcucaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcuggaguccacccgcaucuaccagauccucgcgaucuacucgaccgucgccagcucccuggugcugguggucucgcucggggccaucuccuucuggaugugcagcggccugcagugccggaucugcaucuga

SEQ ID NO: 3800 - RNA, 1698 nt, Artificial Sequence
  derived and/or modified CDS sequence (AUadapt) from InfluenzaA__ACY77743__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcuccucgcgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccucgcugcccuuccagaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagguggggaacggcugcuucgaguucuaccacaagugcgacaacacgugcauggaguccgugaagaacgggaccuacgacuaccccaaguacucggaggaggccaagcugaaccgggaggagaucgacggcgucaagcucgaguccacccgcaucuaccagauccuggcgaucuacagcaccguggccucgucccuggugcucgucgugagccugggggccaucuccuucuggaugugcagcuggucccugcagugccggaucugcaucuga

SEQ ID NO: 3801 - RNA, 1701 nt, Artificial Sequence; identical to SEQ ID NO: 116
  derived and/or modified CDS sequence (AUadapt) from InfluenzaA__ACY77753__HA

SEQ ID NO: 3802 - RNA, 1695 nt, Artificial Sequence
  derived and/or modified CDS sequence (AUadapt) from InfluenzaA__ACY77783__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcugggggacaagcacaacggcaagcucugcaagcugcgcggggucgcgccccugcaccucggcaagugcaacaucgccggguggauccugggcaacccggagugcgagucgcuguccaccgccagcuccuggucguacaucguggagaccuccagcuccgacaacggcacgugcuaccccggggacuucaucgacuacgaggagcuccgggagcagcugucguccgugagcuccuucgagcgcuucgagaucuuccccaagaccucguccuggcccaaccacgacagcgacaagggcgucaccgccgccugcccgcacgccggggcgaaguccuucuacaagaaccugaucuggcucgugaagaagggcaacucguaccccaagcuguccaagagcuacaucaacgacaaggggaaggaggugcugguccucuggggcauccaccaccccucgaccuccgccgaccagcagagccuguaccagaacgccgacacguacguguucgugggcaccucccgguacucgaagaaguucaagcccgagaucgccauccgcccgaagguccgggaccaggaggggcgcaugaacuacuacuggacccugguggagcccggcgacaagaucaccuucgaggccacggggaaccucguggucccccgguacgcguucgccauggagcgcaacgccggcuccggcaucaucaucagcgacacccccgugcacgacugcaacacgaccugccagaccccgaagggggccaucaacaccucccugcccuuccagaacauccaccccaucaccaucggcaagugccccaaguacgucaagucgaccaagcugcggcucgccacggggcugcgcaacgugccguccauccagagccggggccuguucggggcgaucgccggcuucaucgagggcggguggaccggcaugguggacgggugguacggcuaccaccaccagaacgagcagggguccggcuacgccgccgaccucaagucgacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagucccucuacgagaagguccgcucgcagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcaucuaccagauccuggccaucuacucgaccgucgcgagcucccuggugcucguggucucgcugggcgccaucuccuucuggaugugcagcggccacuccugccggaucugcaucuga

SEQ ID NO: 3803 - RNA, 1698 nt, Artificial Sequence
  derived and/or modified CDS sequence (AUadapt) from InfluenzaA__ACY77813__HA
augaaggccauccuggugguccugcuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacgggccagugcaaggaguucaaccaccuggagaagcgcaucgagaaccugaacaagaagguggacgacggcuuccucgacaucuggaccuacaacgccgagcugcugguccuccuggagaacgagcggacccuggacuaccacgacucgaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagucgacccgcaucuaccagauccuggccaucuacuccaccguggcgagcucgcugguccucguggugucccugggggccaucagcuucuggaugugcuccggccaccuccagugccggaucugcaucuga

SEQ ID NO: 3804 - RNA, 1698 nt, Artificial Sequence
  derived and/or modified CDS sequence (AUadapt) from InfluenzaA__ACY77823__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacgggccagugcaaggaguucaaccaccuggagaagcgcaucgagaaccugaacaagaagguggacgacggcuuccucgacaucuggaccuacaacgccgagcugcugguccuccuggagaacgagcggacccuggacuaccacgacucgaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagucgacccgcaucuaccagauccuggccaucuacuccaccguggcgagcucgcugguccucguggugucccugggggccaucagcuucuggaugugcuccuggagccugcagugccggaucugcaucuga

SEQ ID NO: 3805 - RNA, 1698 nt, Artificial Sequence
  derived and/or modified CDS sequence (AUadapt) from InfluenzaA__ACY77833__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgacccgcaucuaccagauccuggcgaucuacuccaccgucgccagcucgcuggugcucguggucucccugggggccaucagcuucuggaugugcuccuggagccugcagugccggaucugcaucuga

SEQ ID NO: 3806 - RNA, 1698 nt, Artificial Sequence
  derived and/or modified CDS sequence (AUadapt) from InfluenzaA__ACY77843__HA
augaaggccauccugguggucaugcuguacaccuucgccaccgcgaacgccgacacgcugugcaucggcuaccacgccaacaacucgaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccagcuccgacaacggcacgugcuaccccggcgacuucaucgacuacgaggagcugcgggagcagcucucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcuggugaagaaggggaacucguaccccaagcucuccaagagcuacaucaacgacaagggcaaggaggugcugguccugugggggauccaccaccccucgaccuccgccgaccagcagagccucuaccagaacgccgacgccuacguguucgugggcuccucgcgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggagcggcaucaucaucuccgacaccacggugcacgacugcaacacgaccugccagacccccaagggcgccaucaacaccucgcucccguuccagaacauccaccccaucaccaucgggaagugccccaaguacgugaaguccaccaagcugcggcuggcgaccggccuccgcaacguccccagcauccagucccgggggcuguucggcgccaucgccggguucaucgagggcggcuggacggggaugguggacggcugguacggguaccaccaccagaacgagcagggcucgggguacgccgccgaccugaaguccacccagaacgcgaucgacgagaucaccaacaaggugaacagcgucaucgagaagaugaacacccaguucacggccgugggcaaggaguucaaccaccucgagaagcgcaucgagaaccugaacaagaaggucgacgacggcuuccuggacaucuggaccuacaacgccgagcuccuggugcugcucgagaacgagcggacccuggacuaccacgacuccaacgugaagaaccuguacgagaagguccgcucgcagcucaagaacaacgccaaggagaucgggaacggcugcuucgaguucuaccacaagugcgacaacacgugcauggaguccgugaagaacgggaccuacgacuacccgaaguacagcgaggaggccaagcugaaccgggaggagaucgacggcgugaagcuggaguccacccgcaucuaccagauccucgcgaucuacucgaccgucgccagcucccuggugcugguggucucgcucggggccaucuccuucuggaugugcagcggccaccuccagugccggaucugcaucuga

SEQ ID NO: 3807 - RNA, 1701 nt, Artificial Sequence
  derived and/or modified CDS sequence (AUadapt) from InfluenzaA__ACY77863__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgacccgcaucuaccagauccuggcgaucuacuccaccgucgccagcucgcuggugcucguggucucccugggggccaucagcuucuggaugugcuccggcaugagccugcagugccggaucugcaucuga

SEQ ID NO: 3808 - RNA, 1701 nt, Artificial Sequence; identical to SEQ ID NO: 62
  derived and/or modified CDS sequence (AUadapt) from InfluenzaA__ACY77874__HA

SEQ ID NO: 3809 - RNA, 1701 nt, Artificial Sequence; identical to SEQ ID NO: 62
  derived and/or modified CDS sequence (AUadapt) from InfluenzaA__ACY77884__HA

SEQ ID NO: 3810 - RNA, 1701 nt, Artificial Sequence
  derived and/or modified CDS sequence (AUadapt) from InfluenzaA__ACY77904__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcuccucgaaguacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccucgcugcccuuccagaacauccaccccaucacgaucgggaagugccccaagcacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcucgggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgugaagcucgaguccacccggaucuaccagauccuggcgaucuacucgaccgucgccagcucccuggugcucguggucucgcugggggccaucuccuucuggaugugcagcaacggcucccugcagugccgcaucugcaucuga

SEQ ID NO: 3811 - RNA, 1701 nt, Artificial Sequence; identical to SEQ ID NO: 96
  derived and/or modified CDS sequence (AUadapt) from InfluenzaA__ACY77914__HA

SEQ ID NO: 3812 - RNA, 1701 nt, Artificial Sequence
  derived and/or modified CDS sequence (AUadapt) from InfluenzaA__ACY77924__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacgacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 3813 - RNA, 1701 nt, Artificial Sequence; identical to SEQ ID NO: 3662
  derived and/or modified CDS sequence (AUadapt) from InfluenzaA__ACY77934__HA

SEQ ID NO: 3814 - RNA, 1701 nt, Artificial Sequence
  derived and/or modified CDS sequence (AUadapt) from InfluenzaA__ACY77944__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgagucggggaucaucaucuccgacacccccgugcacgacugcaacacgaccugccagaccccgaagggcgccaucaacaccagccugcccuuccagaacauccaccccaucacgaucggcaagugccccaaguacgugaaguccaccaagcugcggcucgcgaccgggcugcgcaacgucccgucgauccagucccggggccuguucggggccaucgccggcuucaucgagggcggguggaccggcaugguggacgggugguacggcuaccaccaccagaacgagcaggggagcggcuacgccgccgaccucaaguccacgcagaacgcgaucgacgagaucaccaacaaggugaacucggucaucgagaagaugaacacccaguucaccgccguggggaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucggcaacgggugcuucgaguucuaccacaagugcgacaacacgugcauggaguccgugaagaacggcaccuacgacuaccccaaguacucggaggaggccaagcugaaccgggaggagaucgacggggugaagcucgaguccacccgcaucuaccagauccuggcgaucuacagcaccgucgccucgucccuggugcucguggucagccugggcgccaucuccuucuggaugugcagcaacgggucccugcagugccggaucugcaucuga

SEQ ID NO: 3815 - RNA, 1701 nt, Artificial Sequence; identical to SEQ ID NO: 62
  derived and/or modified CDS sequence (AUadapt) from InfluenzaA__ACY77954__HA

SEQ ID NO: 3816 - RNA, 1701 nt, Artificial Sequence; identical to SEQ ID NO: 62
  derived and/or modified CDS sequence (AUadapt) from InfluenzaA__ACY77964__HA

SEQ ID NO: 3817 - RNA, 1701 nt, Artificial Sequence; identical to SEQ ID NO: 62
  derived and/or modified CDS sequence (AUadapt) from InfluenzaA__ACY77974__HA

SEQ ID NO: 3818 - RNA, 1701 nt, Artificial Sequence; identical to SEQ ID NO: 62
  derived and/or modified CDS sequence (AUadapt) from InfluenzaA__ACY77984__HA

SEQ ID NO: 3819 - RNA, 1701 nt, Artificial Sequence; identical to SEQ ID NO: 62
  derived and/or modified CDS sequence (AUadapt) from InfluenzaA__ACY77994__HA

SEQ ID NO: 3820 - RNA, 1701 nt, Artificial Sequence
  derived and/or modified CDS sequence (AUadapt) from InfluenzaA__ACY79633__HA
augaaggagauccuggugguccuccuguacaccuucgccaccgccaacgcggacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgccaaguccuucuacaagaaccugaucuggcucgugaagaaggggaacucguaccccaagcuguccaagagcuacaucaacgacaagggcaaggaggugcugguccucugggggauccaccaccccucgaccuccgcggaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggccaccggcaaccucguggucccccgguacgcguucgccauggagcgcaacgcccgguccgggaucaucaucagcgacacgcccgugcacgacugcaacacgaccugccagaccccgaagggcgccaucaacaccucccugcccuuccagaacauccaccccaucaccaucggcaagugccccaaguacgucaagucgaccaagcugcgccucgccaccgggcugcggaacgugccguccauccagagccgcggccuguucggggcgaucgccggcuucaucgagggcggguggacgggcaugguggacgggugguacggcuaccaccaccagaacgagcagggguccggcuacgccgccgaccucaagucgacccagaacgccaucgacgagaucaccaacaaggugaacuccgucaucgagaagaugaacacccaguucacggcgguggggaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgcgaggagaucgacggggugaagcucgagagcacccggaucuaccagauccuggccaucuacuccaccgucgcgucgagccuggugcucguggucucccugggcgccaucucguucuggaugugcuccaacgggagccugcagugccgcaucugcaucuga

SEQ ID NO: 3821 - RNA, 1701 nt, Artificial Sequence; identical to SEQ ID NO: 3712
  derived and/or modified CDS sequence (AUadapt) from InfluenzaA__ACZ01953__HA

SEQ ID NO: 3822 - RNA, 1701 nt, Artificial Sequence
  derived and/or modified CDS sequence (AUadapt) from InfluenzaA__ACZ05050__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcucccacgccggcgccaagagcuucuacaagaaccugaucuggcucgugaagaaggggaacuccuacccgaagcugucgaagagcuacaucaacgacaagggcaaggaggugcugguccucugggggauccaccaccccuccaccagcgccgaccagcagucccuguaccagaacgccgacgccuacguguucgugggcucgucccgguacagcaagaaguucaagcccgagaucgccauccgccccaagguccgggaccaggagggccgcaugaacuacuacuggacgcugguggagccgggggacaagaucaccuucgaggcgaccggcaaccucguggucccccgguacgccuucgccauggagcgcaacgccggguccggcaucaucaucucggacacccccgugcacgacugcaacacgaccugccagacccccaagggcgccaucaacaccucccugccguuccagaacauccaccccaucacgaucgggaagugccccaaguacgucaagagcaccaagcugcggcucgcgaccggccugcgcaacgugcccuccauccagucgcgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacacgugcauggagagcgugaagaacgggaccuacgacuacccgaaguacuccgaggaggccaagcugaaccgggaggagaucgacggcgugaagcucgagucgacccgcaucuaccagauccuggcgaucuacagcaccgucgccuccucgcuggugcucguggucucccugggggccaucagcuucuggaugugcuccaacggcagccugcagugccggaucugcaucuga

SEQ ID NO: 3823 - RNA, 1701 nt, Artificial Sequence
  derived and/or modified CDS sequence (AUadapt) from InfluenzaA__ACZ05061__HA
auggaggccauccuggugguccuccuguacaccuucaccacggccaacgcggacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagacguccucguccgacaacgggaccugcuaccccggcgacuucaucgacuacgaggagcuccgggagcagcugagcuccgugucguccuucgagcgcuucgagaucuuccccaagaccagcuccuggcccaaccacgacagcaacaagggggucaccgccgccugcccgcacgccggcgccaaguccuucuacaagaaccugaucuggcucgugaagaaggggaacucguaccccaagcuguccaagagcuacaucaacgacaagggcaaggaggugcugguccucugggggauccaccaccccucgacguccgcggaccagcagagccuguaccagaacgccgacgccuacguguucgugggcuccucgcgguacuccaagaaguucaagcccgagaucgccauccgcccgaagguccgggaccaggagggccgcaugaacuacuacuggacccugguggagcccggggacaagaucaccuucgaggccaccggcaaccucguggucccccgguacgcguucgccauggagcgcaacgccgggagcggcaucaucaucuccgacacgcccgugcacgacugcaacacgaccugccagacccugaagggcgccaucaacaccucgcugccguuccagaacauccaccccaucaccaucgggaagugccccaaguacgugaaguccaccaagcuccggcuggccaccggccugcgcaacguccccagcauccagucccggggccucuucggcgcgaucgccggguucaucgagggcggcuggacggggaugguggacggcugguacggguaccaccaccagaacgagcagggcagcggguacgccgccgaccugaaguccacccagaacgccaucgacgagaucaccaacaaggugaacucggucaucgagaagaugaacacccaguucacggcggugggcaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacuccaacgugaagaaccuguacgagaagguccgcagccagcugaagaacaacgccaaggagaucgggaacggcugcuucgaguucuaccacaagugcgacaacacgugcauggaguccgugaagaacgggaccuacgacuacccgaaguacucggaggaggccaagcucaaccgggaggagaucgacggcgugaagcuggaguccacccgcaucuaccagauccuggccaucuacagcaccgucgcgucgucccucgugcugguggucagccugggggccaucuccuucuggaugugcagcaacggcucccuccagugccggaucugcaucuga

SEQ ID NO: 3824 - RNA, 1701 nt, Artificial Sequence; identical to SEQ ID NO: 62
  derived and/or modified CDS sequence (AUadapt) from InfluenzaA__ACZ05071__HA

SEQ ID NO: 3825 - RNA, 1701 nt, Artificial Sequence; identical to SEQ ID NO: 62
  derived and/or modified CDS sequence (AUadapt) from InfluenzaA__ACZ05081__HA

SEQ ID NO: 3826 - RNA, 1701 nt, Artificial Sequence; identical to SEQ ID NO: 62
  derived and/or modified CDS sequence (AUadapt) from InfluenzaA__ACZ05091__HA

SEQ ID NO: 3827 - RNA, 1701 nt, Artificial Sequence; identical to SEQ ID NO: 62
  derived and/or modified CDS sequence (AUadapt) from InfluenzaA__ACZ05101__HA

SEQ ID NO: 3828 - RNA, 1701 nt, Artificial Sequence; identical to SEQ ID NO: 62
  derived and/or modified CDS sequence (AUadapt) from InfluenzaA__ACZ05111__HA

SEQ ID NO: 3829 - RNA, 1701 nt, Artificial Sequence
  derived and/or modified CDS sequence (AUadapt) from InfluenzaA__ACZ05121__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaacaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcaugggguccgugaagaacggcaccuacgacuaccccaaguacucggaggaggccaagcugaaccgggaggagaucgacggggugaagcucgaguccacccgcaucuaccagauccuggcgaucuacagcaccgucgccucgucccuggugcucguggucagccugggcgccaucuccuucuggaugugcagcaacggcucccugcagugccggaucugcaucuga

SEQ ID NO: 3830 - RNA, 1701 nt, Artificial Sequence; identical to SEQ ID NO: 62
  derived and/or modified CDS sequence (AUadapt) from InfluenzaA__ACZ05131__HA

SEQ ID NO: 3831 - RNA, 1701 nt, Artificial Sequence; identical to SEQ ID NO: 62
  derived and/or modified CDS sequence (AUadapt) from InfluenzaA__ACZ05141__HA

SEQ ID NO: 3832 - RNA, 1701 nt, Artificial Sequence; identical to SEQ ID NO: 62
  derived and/or modified CDS sequence (AUadapt) from InfluenzaA__ACZ05151__HA

SEQ ID NO: 3833 - RNA, 1701 nt, Artificial Sequence
  derived and/or modified CDS sequence (AUadapt) from InfluenzaA__ACZ05172__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcaagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccaggacggcaccuccucggccugcauccgccgguccaagaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcagaccgccaucccgaacaucggcucgcggccccgcgugcggaacauccccucccgcaucagcaucuacuggaccaucgucaagcccggcgacauccugcucaucaacuccaccgggaaccugaucgccccgcggggcuacuucaagauccgcucggggaaguccagcaucaugcgguccgacgcccccaucggcaagugcaacucggagugcaucacgcccaacggcuccauccccaacgacaagccguuccagaacgugaaccgcaucaccuacggggcgugcccccgguacgugaagcagaacacccugaagcucgccaccggcaugcgcaacguccccgagaagcagacgcgggggaucuucggcgccaucgccggguucaucgagaacggcugggagggcaugguggacgggugguacggcuuccgccaccagaacucggaggggcggggccaggccgcggaccugaaguccacccaggccgccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacacgaucgaccucaccgacucggagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacguguaccgggacgaggcccucaacaaccgcuuccagaucaagggggucgagcugaaguccggcuacaaggacuggauccuguggaucuccuucgccaucagcugcuuccuccugugcguggcccugcucggcuucaucaugugggcgugccagaaggggaacauccggugcaacaucugcaucuga

SEQ ID NO: 3834 - RNA, 1698 nt, Artificial Sequence; identical to SEQ ID NO: 3376
  derived and/or modified CDS sequence (AUadapt) from InfluenzaA__ACZ05194__HA

SEQ ID NO: 3835 - RNA, 1701 nt, Artificial Sequence; identical to SEQ ID NO: 3833
  derived and/or modified CDS sequence (AUadapt) from InfluenzaA__ACZ05205__HA

SEQ ID NO: 3836 - RNA, 1701 nt, Artificial Sequence
  derived and/or modified CDS sequence (AUadapt) from InfluenzaA__ACZ05216__HA
augaagaccaucaucgcccugucguacauccucugccugguguucgcccagaagauccccggcaacgacaacaacaccgcgacgcugugccucgggcaccacgccgucccgaacggcaccaucgugaagaccaucaccaacgaccagaucgaggugacgaacgccaccgagcugguccaguccucguccaccggggagaucugcgacagcccccaccagauccuggacggcgagaacugcacccucaucgacgcccugcugggggacccccagugcgacggcuuccagaacaagaagugggaccucuucguggagcgcuccaaggccuacucgaacugcuaccccuacgacgugccggacuacgcgucccugcggagccuggucgccuccucgggcacgcucgaguucaacaacgaguccuucaacuggaccggggugacccagaacggcaccucguccgccugcauccgccggagcaacaacuccuucuucucgcgccugaacuggcugacgcaccucaaguucaaguaccccgcccugaacgugaccaugcccaacaacgagcaguucgacaagcuguacaucuggggcguccaccaccccgggaccgacaacgaccagaucuuccucuacgcgcaggccuccgggcggaucaccgugagcacgaagcgcucccagcagaccgugaucccgaacaucggcucgcggccccgcguccggaacauccccucgcgcaucuccaucuacuggaccaucgugaagcccggcgacauccugcugaucaacagcaccgggaaccucaucgccccgcggggcuacuucaagauccgcuccggcaagucguccaucaugcggagcgacgcccccaucgggaagugcaacuccgagugcaucacgcccaacggcucgauccccaacgacaagccguuccagaacgugaaccgcaucaccuacggggccugcccccgguacgucaagcagaacacccugaagcuggcgaccggcaugcgcaacgugcccgagaagcagacgcgggggaucuucggcgccaucgccggguucaucgagaacggcugggagggcaugguggacgggugguacggcuuccgccaccagaacuccgaggggcggggccaggccgccgaccucaagucgacccaggcggccaucgaccagaucaacgggaagcugaaccgccugaucggcaagaccaacgagaaguuccaccagaucgagaaggaguucuccgaggucgagggccggauccaggaccucgagaaguacguggaggacaccaagaucgaccuguggagcuacaacgccgagcugcucguggcccuggagaaccagcacacgaucgaccugaccgacuccgagaugaacaagcuguucgagaagaccaagaagcagcuccgcgagaacgccgaggacauggggaacggcugcuucaagaucuaccacaagugcgacaacgcgugcaucgggucgauccgcaacggcaccuacgaccacgacgucuaccgggacgaggcccugaacaaccgcuuccagaucaaggggguggagcucaaguccggcuacaaggacuggauccuguggaucagcuucgccaucuccugcuuccugcucugcguggcccugcugggcuucaucaugugggccugccagaaggggaacauccggugcaacaucugcaucuga

SEQ ID NO: 3837 - RNA, 1701 nt, Artificial Sequence; identical to SEQ ID NO: 3833
  derived and/or modified CDS sequence (AUadapt) from InfluenzaA__ACZ05227__HA

SEQ ID NO: 3838 - RNA, 1701 nt, Artificial Sequence
  derived and/or modified CDS sequence (AUadapt) from InfluenzaA__ACZ05238__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcaagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacugggccggggugacccagaacggcaccuccucggccugcauccgccgguccaagaacucguucuucucccgccugaacuggcucacccaccugaacuucaaguaccccgcgcugaacgugacgaugcccaacaacgagcaguucgacaagcucuacaucuggggcguccaccaccccgggaccgacaaggaccagaucuuccuguacgcccaggccagcgggcggaucaccguguccaccaagcgcucgcagcagacggccaucccgaacaucggcucgcggccccgcgugcggaacauccccucccgcaucagcaucuacuggaccaucgucaagcccggcgacauccugcucaucaacuccaccgggaaccugaucgccccgcggggcuacuucaagauccgcucggggaaguccagcaucaugcgguccgacgcgcccaucggcaagugcaacucggagugcaucacccccaacggcuccauccccaacgacaagccguuccagaacgugaaccgcaucacguacggggccugcccccgguacgugaagcagaacacccugaagcucgccaccggcaugcgcaacguccccgagaagcagacccgggggaucuucggcgccaucgccggguucaucgagaacggcugggagggcaugguggacgggugguacggcuuccgccaccagaacucggaggggcggggccaggcggccgaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcgcuggagaaccagcacaccaucgaccucacggacucggagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaagggggucgagcugaaguccggcuacaaggacuggauccuguggaucuccuucgccaucagcugcuuccuccugugcguggcgcugcucggcuucaucaugugggccugccagaaggggaacauccggugcaacaucugcaucuga

SEQ ID NO: 3839 - RNA, 1701 nt, Artificial Sequence; identical to SEQ ID NO: 3833
  derived and/or modified CDS sequence (AUadapt) from InfluenzaA__ACZ05249__HA

SEQ ID NO: 3840 - RNA, 1701 nt, Artificial Sequence; identical to SEQ ID NO: 3833
  derived and/or modified CDS sequence (AUadapt) from InfluenzaA__ACZ05260__HA

SEQ ID NO: 3841 - RNA, 1701 nt, Artificial Sequence
  derived and/or modified CDS sequence (AUadapt) from InfluenzaA__ACZ05271__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccucggggcggaucaccguguccacgaagcgcagccagcagaccgugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagcggcagacgcgcgggaucuucggcgccaucgccggguucaucgagaacggcugggagggcaugguggacgggugguacggcuuccggcaccagaacucggaggggcgcggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgcgagaacgccgaggacauggggaacggcugcuucaagaucuaccacaagugcgacaacgcgugcaucggguccauccggaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 3842 - RNA, 1701 nt, Artificial Sequence
  derived and/or modified CDS sequence (AUadapt) from InfluenzaA__ACZ05282__HA
augaagaccaccaucgcccugucguacauccucugccugguguucgcccagaagcugcccggcaacgacaacuccacggcgacccucugccuggggcaccacgccgucccgaacggcaccaucgugaagaccaucacgaacgaccagaucgaggugaccaacgccaccgagcugguccagucguccagcaccggggagaucugcgacucgccccaccagauccucgacggcgagaacugcacgcugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacccuggaguucaacaacgagagcuucaacuggaccggggugacccagaacggcacguccucggccugcauccgccgguccaacaacucguucuucucccgccugaacuggcucacccaccugaaguucaaguaccccgcccugaacgugaccaugcccaacaacgagcaguucgacaagcucuacaucuggggcguccaccaccccgggaccgacaacgaccagaucuuccuguacgcgcaggccagcgggcggaucacgguguccaccaagcgcucgcagcagaccgugaucccgaacaucggcucgcggccccgcguccggaacauccccucccgcaucagcaucuacuggaccaucgugaagcccggcgacauccugcucaucaacuccacggggaaccugaucgccccgcggggcuacuucaagauccagucggggaaguccagcaucaugcgcuccgacgcccccaucggcaagugcaacucggagugcaucacccccaacggcuccauccccaacgacaagccguuccagaacgugaaccggaucaccuacggggccugcccccgcuacgucaagcagaacacccugaagcucgcgacgggcaugcggaacgugcccgagaagcagacccgcgggaucuucggcgccaucgccggguucaucgagaacggcugggagggcaugguggacgggugguacggcuuccggcaccagaacucggaggggcgcggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacacgaagaucgaccugugguccuacaacgccgagcuccugguggcccuggagaaccagcacaccaucgaccucaccgacucggagaugaacaagcuguucgagaagaccaagaagcagcugcgggagaacgccgaggacauggggaacggcugcuucaagaucuaccacaagugcgacaacgcgugcaucggguccauccgcaacggcacguacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 3843 - RNA, 1701 nt, Artificial Sequence; identical to SEQ ID NO: 3833
  derived and/or modified CDS sequence (AUadapt) from InfluenzaA__ACZ05304__HA

SEQ ID NO: 3844 - RNA, 1701 nt, Artificial Sequence; identical to SEQ ID NO: 3656
  derived and/or modified CDS sequence (AUadapt) from InfluenzaA__ACZ05315__HA

SEQ ID NO: 3845 - RNA, 1701 nt, Artificial Sequence; identical to SEQ ID NO: 3833
  derived and/or modified CDS sequence (AUadapt) from InfluenzaA__ACZ05326__HA

SEQ ID NO: 3846 - RNA, 1701 nt, Artificial Sequence
  derived and/or modified CDS sequence (AUadapt) from InfluenzaA__ACZ05337__HA
augaagaccaucaucgcccugucguacauccucugccugguguucacccagaagcugcccggcaacgacaacuccacggccacccucugccuggggcaccacgcggucccgaacggcaccaucgugaagaccaucacgaacgaccagaucgaggugaccaacgccaccgagcugguccagucguccagcaccggggagaucugcgacucgccccaccagauccucgacggcaagaacugcacgcugaucgacgcccugcucggggacccccagugcgacggcuuccagaacaagaagugggaccuguucguggagcgcagcaaggccuacuccaacugcuaccccuacgacgugccggacuacgccucgcugcggucccucgucgcgagcuccggcacccuggaguucaacaacgagcgcuucaacuggaccggggugacccagaacggcacgucguccgccugcauccggcgcagcaagaacuccuucuucucgcggcugaacuggcucacccaccugaacuucaaguaccccgcccugaacgugaccaugcccaacaacgagcaguucgacaagcucuacaucuggggcguccaccaccccgggaccgacaaggaccagaucuuccuguacgcccaggcguccgggcgcaucacggugagcaccaagcggucccagcagaccgugaucccgaacaucggcucgcgcccccggguccgcaacauccccagccggaucuccaucuacuggaccaucgugaagcccggcgacauccugcucaucucguccacggggaaccugaucgccccgcgcggcuacuucaagauccggagcgggaaguccucgaucaugcgcuccgacgcccccaucggcaagugcaacagcgagugcaucacccccaacggcuccauccccaacgacaagccguuccagaacgugaaccggaucaccuacggggccugcccccgcuacgucaagcagaacacccugaagcucgccacgggcaugcggaacgugcccgagaagcagacccgcgggaucuucggcgcgaucgccggguucaucgagaacggcugggagggcaugguggacgggugguacggcuuccggcaccagaacucggaggggcgcggccaggccgccgaccugaaguccacccaggccgcgaucgaccagaucaacgggaagcugaaccggcucaucggcaagaccaacgagaaguuccaccagaucgagaaggaguucagcgaggucgagggccgcauccaggaccuggagaaguacguggaggacacgaagaucgaccugugguccuacaacgccgagcuccugguggcccuggagaaccagcacaccaucgaccucaccgacucggagaugaacaagcuguucgagaagaccaagaagcagcugcgcgagaacgccgaggacauggggaacggcugcuucaagaucuaccacaagugcgacaacgccugcaucggguccauccggaacggcacguacgaccacgacgucuaccgcgacgaggcgcucaacaaccgguuccagaucaaggggguggagcugaaguccggcuucaaggacuggauccuguggaucuccuucgccaucagcugcuuccuccugugcguggcccugcucggcuucaucaugugggccugccagaaggggaacauccgcugcaacaucugcaucuga

SEQ ID NO: 3847 - RNA, 1701 nt, Artificial Sequence; identical to SEQ ID NO: 3833
  derived and/or modified CDS sequence (AUadapt) from InfluenzaA__ACZ05348__HA

SEQ ID NO: 3848 - RNA, 1701 nt, Artificial Sequence; identical to SEQ ID NO: 3838
  derived and/or modified CDS sequence (AUadapt) from InfluenzaA__ACZ05359__HA

SEQ ID NO: 3849 - RNA, 1701 nt, Artificial Sequence; identical to SEQ ID NO: 3833
  derived and/or modified CDS sequence (AUadapt) from InfluenzaA__ACZ05370__HA

SEQ ID NO: 3850 - RNA, 1701 nt, Artificial Sequence
  derived and/or modified CDS sequence (AUadapt) from InfluenzaA__ACZ05392__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcaagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcgccuccucggccugcauccgccgguccaagaacucguucuucucccgccugaacuggcucacccaccugaacuucaaguaccccgcgcugaacgugacgaugcccaacaacgagcaguucgacaagcucuacaucuggggcguccaccaccccgggaccgacaaggaccagaucuuccuguacgcccaggccagcgggcggaucaccguguccaccaagcgcucgcagcagacggccaucccgaacaucggcucgcggccccgcgugcggaacauccccucccgcaucagcaucuacuggaccaucgucaagcccggcgacauccugcucaucaacuccaccgggaaccugaucgccccgcggggcuacuucaagauccgcucggggaaguccagcaucaugcgguccgacgcgcccaucggcaagugcaacucggagugcaucacccccaacggcuccauccccaacgacaagccguuccagaacgugaaccgcaucacguacggggccugcccccgguacgugaagcagaacacccugaagcucgccaccggcaugcgcaacguccccgagaagcagacccgggggaucuucggcgccaucgccggguucaucgagaacggcugggagggcaugguggacgggugguacggcuuccgccaccagaacucggaggggcggggccaggcggccgaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcgcuggagaaccagcacaccaucgaccucacggacucggagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaagggggucgagcugaaguccggcuacaaggacuggauccuguggaucuccuucgccaucagcugcuuccuccugugcguggcgcugcucggcuucaucaugugggccugccagaaggggaacauccggugcaacaucugcaucuga

SEQ ID NO: 3851 - RNA, 1701 nt, Artificial Sequence; identical to SEQ ID NO: 3833
  derived and/or modified CDS sequence (AUadapt) from InfluenzaA__ACZ05403__HA

SEQ ID NO: 3852 - RNA, 1701 nt, Artificial Sequence
  derived and/or modified CDS sequence (AUadapt) from InfluenzaA__ACZ05436__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcaagagcugcacccugaucgacgcccugcucggggacccccagugcgacggcuuccagaacaagaagugggaccuguucguggagcgcuccaaggccuacucgaacugcuaccccuacgacgugccggacuacgcgucccugcggagccucgucgccuccucgggcacgcuggaguucaacaacgaguccuucaacuggaccggggugacccagaacggcaccucguccgccugcauccgccggagcaagaacuccuucuucucgcgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugagcacgaagcgcucgcagcagaccgccaucccgaacaucggcucccggccccgcgugcggaacauccccagccgcaucuccaucuacuggaccaucgucaagcccggcgacauccugcucaucaacucgaccgggaaccugaucgccccgcggggcuacuucaagauccgcuccgggaaguccuccaucaugcggucggacgcccccaucggcaagugcaacuccgagugcaucacgcccaacggcagcauccccaacgacaagccguuccagaacgugaaccgcaucaccuacggggcgugcccccgguacgugaagcagaacacccugaagcucgccaccggcaugcgcaacguccccgagaagcagacgcgggggaucuucggcgccaucgccggguucaucgagaacggcugggagggcaugguggacgggugguacggcuuccgccaccagaacuccgaggggcggggccaggccgcggaccucaagucgacccaggccgccaucgaccagaucaacgggaagcugaaccgccugaucggcaagaccaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgcggaggacauggggaacggcugcuucaagaucuaccacaagugcgacaacgccugcaucgggucgauccgcaacggcaccuacgaccacgacguguaccgggacgaggcccucaacaaccgcuuccagaucaagggggucgagcugaaguccggcuacaaggacuggauccuguggaucagcuucgccaucuccugcuuccuccugugcguggcccugcucggcuucaucaugugggcgugccagaaggggaacauccggugcaacaucugcaucuga

SEQ ID NO: 3853 - RNA, 1701 nt, Artificial Sequence; identical to SEQ ID NO: 3833
  derived and/or modified CDS sequence (AUadapt) from InfluenzaA__ACZ05458__HA

SEQ ID NO: 3854 - RNA, 1701 nt, Artificial Sequence; identical to SEQ ID NO: 3833
  derived and/or modified CDS sequence (AUadapt) from InfluenzaA__ACZ05469__HA

SEQ ID NO: 3855 - RNA, 1701 nt, Artificial Sequence; identical to SEQ ID NO: 3852
  derived and/or modified CDS sequence (AUadapt) from InfluenzaA__ACZ05480__HA

SEQ ID NO: 3856 - RNA, 1701 nt, Artificial Sequence; identical to SEQ ID NO: 3656
  derived and/or modified CDS sequence (AUadapt) from InfluenzaA__ACZ05513__HA

SEQ ID NO: 3857 - RNA, 1701 nt, Artificial Sequence; identical to SEQ ID NO: 3833
  derived and/or modified CDS sequence (AUadapt) from InfluenzaA__ACZ05524__HA

SEQ ID NO: 3858 - RNA, 1701 nt, Artificial Sequence
  derived and/or modified CDS sequence (AUadapt) from InfluenzaA__ACZ05535__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcaagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaagaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcagaccgccaucccgaacaucggcucgcggccccgcgugcggaacauccccucccgcaucagcaucuacuggaccaucgucaagcccggcgacauccugcucaucaacuccaccgggaaccugaucgccccgcggggcuacuucaagauccgcucggggaaguccagcaucaugcgguccgacgcccccaucggcaagugcaacucggagugcaucacgcccaacggcuccauccccaacgacaagccguuccagaacgugaaccgcaucaccuacggggcgugcccccgguacgugaagcagaacacccugaagcucgccaccggcaugcgcaacguccccgagaagcagacgcgggggaucuucggcgccaucgccggguucaucgagaacggcugggagggcaugguggacgggugguacggcuuccgccaccagaacucggaggggcggggccaggccgcggaccugaaguccacccaggccgccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacacgaucgaccucaccgacucggagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacguguaccgggacgaggcccucaacaaccgcuuccagaucaagggggucgagcugaaguccggcuacaaggacuggauccuguggaucuccuucgccaucagcugcuuccuccugugcguggcccugcucggcuucaucaugugggcgugccagaaggggaacauccggugcaacaucugcaucuga

SEQ ID NO: 3859 - RNA, 1701 nt, Artificial Sequence; identical to SEQ ID NO: 3858
  derived and/or modified CDS sequence (AUadapt) from InfluenzaA__ACZ05546__HA

SEQ ID NO: 3860 - RNA, 1701 nt, Artificial Sequence; identical to SEQ ID NO: 3833
  derived and/or modified CDS sequence (AUadapt) from InfluenzaA__ACZ05557__HA

SEQ ID NO: 3861 - RNA, 1698 nt, Artificial Sequence
  derived and/or modified CDS sequence (AUadapt) from InfluenzaA__ACZ05579__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccucguucgagcgguucgagaucuucccgaaggaguccagcuggcccaaccacacggucaccgggguguccgccagcugcucccacaacggcgagagcuccuucuaccgcaaccugcuguggcucaccgugaagaacgggcuguaccccaaccugagcaaguccuacgccaacaacaaggagaaggagguccucgugcuguggggcgugcaccacccgcccaacaucgucgaccagaagacccuguaccggacggagaacgccuacgugucgguggucagcucccacuacagccgcaaguucacccccgagaucgccaagcggcccaaggugcgcgaccaggaggggcggaucaacuacuacuggacccuccuggagcccggcgacaccaucaucuucgaggccaacggcaaccugaucgcgccgcgcuacgccuucgcccucucccggggguucggcagcgggaucaucaacuccaacgcccccauggacaagugcgacgccaagugccagacgccccgcggcgcgaucaacagcucccugcccuuccagaacgugcacccggucaccaucggcgagugccccaaguacgugcggucggccaagcugcgcauggugaccgggcuccggaacauccccuccauccagagccgcggccuguucggggccaucgccggcuucaucgagggcggcuggaccggcauggucgacgggugguacggcuaccaccaccagaacgagcagggguccggcuacgccgcggaccagaaguccacgcagaacgccaucaacgggaucaccaacaaggugaacagcgucaucgagaagaugaacacccaguucaccgccgugggcaaggaguucaacaagcuggagcggcgcauggagaaccucaacaagaagguggacgacggcuucaucgacaucuggacguacaacgccgagcugcugguccuccuggagaacgagcggacccuggacuuccacgacagcaacgugaagaaccucuacgagaaggugaagucccagcugaagaacaacgccaaggagaucgggaacggcugcuucgaguucuaccacaagugcaacgacgagugcauggagagcgucaagaacgggaccuacgacuaccccaaguacuccgaggagucgaagcugaaccgcgagaagaucgacggcgugaagcucgaguccauggggguguaccagauccuggcgaucuacagcaccgucgccagcucccuggugcuccuggugagccugggcgccaucuccuucuggaugugcagcaacggcucccuccagugccggaucugcaucuga

SEQ ID NO: 3862 - RNA, 1698 nt, Artificial Sequence
  derived and/or modified CDS sequence (AUadapt) from InfluenzaA__ACZ05590__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccucgguguccagcuucgagcgguucgagaucuucccgaaggaguccagcuggcccaaccacacggucaccgggguguccgccagcugcucccacaacggcgagucguccuucuaccgcaaccugcuguggcucaccgggaagaacggccuguaccccaaccugagcaaguccuacgccaacaacaaggagaaggaggugcucguccuguggggcgugcaccacccgcccagcaucagcgaccagaagacccuguaccacacggaggacgccuacguguccgucgugagcucccacuacucgcggaaguucacccccgagaucgccaagcgccccaaggugcgggaccaggagggccgcaucaacuacuacuggacccuccuggagcccggcgacaccaucaucuucgaggccaacgggaaccugaucgcgccgcgguacgccuucgcccucucccgcggcuucgggagcggcaucaucaacuccaacgcccccaugggcaagugcgacgccaagugccagacgccccagggggcgaucaacagcucccugcccuuccagaacguccacccggugaccaucggcgagugccccaaguacgugcggagcgccaagcugcgcauggucaccgggcuccggaacauccccuccauccagucgcgcggccuguucggggccaucgccggcuucaucgagggcggguggaccggcaugguggacgggugguacggcuaccaccaccagaacgagcagggguccggcuacgccgcggaccagaaguccacgcagaacgccaucaacggcaucaccaacaaggugaacagcgucaucgagaagaugaacacccaguucaccgccguggggaaggaguucaacaagcuggagcggcgcauggagaaccucaacaagaaggucgacgacggcuucaucgacaucuggacguacaacgccgagcugcuggugcuccuggagaacgagcggacccuggacuuccacgacagcaacgugaagaaccucuacgagaaggucaagucccagcugaagaacaacgccaaggagaucgggaacggcugcuucgaguucuaccacaagugcaacgacgagugcauggagagcgugaagaacgggaccuacgacuaccccaaguacuccgaggagucgaagcugaaccgcgagaagaucgacggcgugaagcucgagagcaugggcgucuaccagauccuggcgaucuacuccaccguggccagcucccuggugcuccuggucagccugggggccaucuccuucuggaugugcagcaacggcucccuccagugccggaucugcaucuga

SEQ ID NO: 3863 - RNA, 1701 nt, Artificial Sequence; identical to SEQ ID NO: 3858
  derived and/or modified CDS sequence (AUadapt) from InfluenzaA__ACZ05950__HA

SEQ ID NO: 3864 - RNA, 1701 nt, Artificial Sequence; identical to SEQ ID NO: 3833
  derived and/or modified CDS sequence (AUadapt) from InfluenzaA__ACZ05961__HA

SEQ ID NO: 3865 - RNA, 1701 nt, Artificial Sequence
  derived and/or modified CDS sequence (AUadapt) from InfluenzaA__ACZ05972__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcaagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagucguucaacuggaccggggugacccagaacggcaccuccagcgccugcauccgccgguccaagaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccucggggcggaucaccguguccacgaagcgcagccagcagaccgccaucccgaacaucggcucgcggccccgcgugcggaacauccccucccgcaucucgaucuacuggaccaucgucaagcccggcgacauccugcucaucaacuccaccgggaaccugaucgccccgcggggcuacuucaagauccgcagcgggaaguccucgaucaugcgguccgacgcccccaucggcaagugcaacucggagugcaucacgcccaacggcuccauccccaacgacaagccguuccagaacgugaaccgcaucaccuacggggcgugcccccgguacgugaagcagaacacccugaagcucgccaccggcaugcgcaacguccccgagaagcagacgcgggggaucuucggcgccaucgccggguucaucgagaacggcugggagggcaugguggacgggugguacggcuuccgccaccagaacagcgaggggcggggccaggccgcggaccugaaguccacccaggccgccaucgaccagaucaacgggaagcugaaccgccucaucggcaagaccaacgagaaguuccaccagaucgagaaggaguucucggagguggagggccggauccaggaccuggagaaguacgucgaggacaccaagaucgaccugugguccuacaacgccgagcuccugguggcccuggagaaccagcacacgaucgaccucaccgacucggagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacguguaccgggacgaggcccucaacaaccgcuuccagaucaagggggucgagcugaaguccggcuacaaggacuggauccuguggaucuccuucgccaucagcugcucccuccugugcguggcccugcucggcuucaucaugugggcgugccagaaggggaacauccggugcaacaucugcaucuga

SEQ ID NO: 3866 - RNA, 1701 nt, Artificial Sequence
  derived and/or modified CDS sequence (AUadapt) from InfluenzaA__ACZ05983__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcaagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagucguucaacuggaccggggugacccagaacggcaccuccagcgccugcauccgccgguccaagaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccucggggcggaucaccguguccacgaagcgcagccagcagaccgccaucccgaacaucggcucgcggccccgcgugcggaacauccccucccgcaucucgaucuacuggaccaucgucaagcccggcgacauccugcucaucaacuccaccgggaaccugaucgccccgcggggcuacuucaagauccgcagcgggaaguccucgaucaugcgguccgacgcccccaucggcaagugcaacucggagugcaucacgcccaacggcuccauccccaacgacaagccguuccagaacgugaaccgcaacaccuacggggcgugcccccgguacgugaagcagaacacccugaagcucgccaccggcaugcgcaacguccccgagaagcagacgcgggggaucuucggcgccaucgccggguucaucgagaacggcugggagggcaugguggacgggugguacggcuuccgccaccagaacagcgaggggcggggccaggccgcggaccugaaguccacccaggccgccaucgaccagaucaacgggaagcugaaccgccucaucggcaagaccaacgagaaguuccaccagaucgagaaggaguucucggagguggagggccggauccaggaccuggagaaguacgucgaggacaccaagaucgaccugugguccuacaacgccgagcuccugguggcccuggagaaccagcacacgaucgaccucaccgacucggagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacguguaccgggacgaggcccucaacaaccgcuuccagaucaagggggucgagcugaaguccggcuacaaggacuggauccuguggaucuccuucgccaucagcugcuuccuccugugcguggcccugcucggcuucaucaugugggcgugccagaaggggaacauccggugcaacaucugcaucuga

SEQ ID NO: 3867 - RNA, 1701 nt, Artificial Sequence
  derived and/or modified CDS sequence (AUadapt) from InfluenzaA__ACZ05994__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcaagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaagaacucguucuucucccgccugaacuggcucacgcaccugaacuucaaguaccccgcccugaacgugaccguccccaacaacgagcaguucgacaagcucuacaucuggggcgugcaccaccccgggaccgacaaggaccagaucuuccuguacgcgcaggccagcgggcggaucaccguguccacgaagcgcucgcagcagaccgccaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccagcaucaugcgguccgacgcccccaucggcaagugcaacucggagugcaucacgcccaacggcuccauccccaacgacaagccguuccagaacgugaaccgcaucaccuacggggcgugcccccgguacgucaagcagaacacccugaagcucgccaccggcaugcgcaacgugcccgagaagcagacgcgggggaucuucggcgccaucgccggguucaucgagaacggcugggagggcaugguggacgggugguacggcuuccgccaccagaacucggaggggcggggccaggccgcggaccugaaguccacccaggccgccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggcgugccagaaggggaacauccggugcaacaucugcaucuga

SEQ ID NO: 3868 - RNA, 1701 nt, Artificial Sequence; identical to SEQ ID NO: 3833
  derived and/or modified CDS sequence (AUadapt) from InfluenzaA__ACZ06005__HA

SEQ ID NO: 3869 - RNA, 1701 nt, Artificial Sequence; identical to SEQ ID NO: 3833
  derived and/or modified CDS sequence (AUadapt) from InfluenzaA__ACZ06016__HA

SEQ ID NO: 3870 - RNA, 1698 nt, Artificial Sequence
  derived and/or modified CDS sequence (AUadapt) from InfluenzaA__ACZ16013__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccucguggcccaaccacacggucaccgggguguccgccagcugcucccacaacggcgagaacagcuucuaccgcaaccugcuguggcucaccgggaagaacggccuguaccccaaccuguccaagucguacgccaacaacaaggagaaggaggugcucguccuguggggcgugcaccacccgcccaacaucgccgaccagaagacccuguaccacacggagaaggccuacguguccgucgugagcagccacuacucccggaaguucacccccgagaucgccaagcgccccaaggugcgggaccaggagggccgcaucaacuacuacuggacccuccuggagcccggcgacaccaucaucuucgaggcgaacgggaaccugaucgccccgcgguacgccuucgcccucucgcgcggcuucggguccggcaucaucaacagcaacgcccccauggacaagugcgacgcgaagugccagacgccccagggcgccaucaacuccagccugcccuuccagaacguccacccggugaccaucggggagugccccaaguacgugcgguccgccaagcugcgcauggucaccggccuccggaacauccccucgauccagucccgcgggcuguucggcgccaucgccggguucaucgagggcggcuggaccgggaugguggacggcugguacggguaccaccaccagaacgagcagggcagcggguacgcggccgaccagaaguccacgcagaacgccaucaacggcaucaccaacaaggugaacagcgucaucgagaagaugaacacccaguucaccgccgugggcaaggaguucaacaagcuggagcggcgcauggagaaccucaacaagaaggucgacgacggguucaucgacaucuggacguacaacgccgagcugcuggugcuccuggagaacgagcggacccuggacuuccacgacuccaacgugaagaaccucuacgagaaggucaagucgcagcugaagaacaacgcgaaggagaucggcaacgggugcuucgaguucuaccacaagugcaacgacgagugcauggaguccgugaagaacggcaccuacgacuaccccaaguacagcgaggaguccaagcugaaccgcgagaagaucgacggggugaagcucgagagcaugggcgucuaccagauccuggccaucuacuccaccguggccucgagccuggugcuccuggucucccugggcgccaucagcuucuggaugugcuccaacgggagccuccagugccggaucugcaucuga

SEQ ID NO: 3871 - RNA, 1698 nt, Artificial Sequence
  derived and/or modified CDS sequence (AUadapt) from InfluenzaA__ACZ16023__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccucguggcccaaccacacggucaccgggguguccgccagcugcucccacaacggcgagaacagcuucuaccgcaaccugcuguggcucaccgggaagaacggccuguaccccaaccuguccaagucguacgccaacaacaaggagaaggaggugcucguccuguggggcgugcaccacccgcccaacaucgccgaccagaagacccuguaccacacggagaacgccuacguguccgucgugagcagccacuacucccggaaguucacccccgagaucgccaagcgccccaaggugcgggaccaggagggccgcaucaacuacuacuggacccuccuggagcccggcgacaccaucaucuucgaggcgaacgggaaccugaucgccccgcgguacgccuucgcccucucgcgcggcuucggguccggcaucaucaacagcaacgcccccauggacaagugcgacgcgaagugccagacgccccagggcgccaucaacuccagccugcccuuccagaacguccacccggugaccaucggggagugccccaaguacgugcgguccgccaagcugcgcauggucaccggccuccggaacauccccucgauccagucccgcgggcuguucggcgccaucgccggguucaucgagggcggcuggaccgggaugguggacggcugguacggguaccaccaccagaacgagcagggcagcggguacgcggccgaccagaaguccacgcagaacgccaucaacggcaucaccaacaaggugaacagcgucaucgagaagaugaacacccaguucaccgccgugggcaaggaguucaacaagcuggagcggcgcauggagaaccucaacaagaaggucgacgacggguucaucgacaucuggacguacaacgccgagcugcuggugcuccuggagaacgagcggacccuggacuuccacgacuccaacgugaagaaccucuacgagaaggucaagucgcagcugaagaacaacgcgaaggagaucggcaacgggugcuucgaguucuaccacaagugcaacgacgagugcauggaguccgugaagaacggcaccuacgacuaccccaaguacagcgaggaguccaagcugaaccgcgagaagaucgacggggugaagcucgagagcaugggcgucuaccagauccuggccaucuacuccaccguggccucgagccuggugcuccuggucucccugggcgccaucagcuucuggaugugcuccaacgggagccuccagugccggaucugcaucuga

SEQ ID NO: 3872 - RNA, 1698 nt, Artificial Sequence
  derived and/or modified CDS sequence (AUadapt) from InfluenzaA__ACZ16033__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucucgaaggaguccuggagcuacaucguggagaagcccaaccccgagaacgggaccugcuaccccggccacuucgccgacuacgaggagcugcgcgagcagcucuccagcguguccucguucgagcgguucgagaucuucccgaaggaguccagcuggcccaaccacacggucaccggggccuccgccagcugcucccacaacggcgagaacucguucuaccgcaaccugcuguggcucaccgggaagaacggccuguaccccaaccuguccaagagcuacgccaacaacaaggagaaggaggugcucgugcuguggggcguccaccacccgcccaacaucgccgaccagaagacccuguaccacacggagaacgccuacguguccguggucagcucgcacuacucccggaaguucacccccgagaucgcgaagcgccccaaggugcgggaccaggagggccgcaucaacuacuacuggacccuccuggagcccggcgacaccaucaucuucgaggccaacgggaaccugaucgccccgcgguacgccuucgcccucagccgcggcuucggguccggcaucaucaacucgaacgcgcccauggacaagugcgacgccaagugccagacgccccagggcgccaucaacuccagccugcccuuccagaacauccacccggugaccaucggggagugccccaaguacguccgguccgccaagcugcgcauggugaccggccuccggaacauccccagcauccagucccgcgggcuguucggcgccaucgcgggguucaucgagggcggcuggaccgggaugguggacggcugguacggguaccaccaccagaacgagcagggcucgggguacgccgccgaccagaaguccacgcagaacgccaucaacggcaucaccaacaaggucaacagcgugaucgagaagaugaacacccaguucaccgccgugggcaaggaguucaacaagcuggagcggcgcauggagaaccucaacaagaaggucgacgacggguucaucgacaucuggacguacaacgcggagcugcuggugcuccuggagaacgagcggacccuggacuuccacgacuccaacgucaagaaccucuacgagaaggucaagagccagcugaagaacaacgccaaggagaucggcaacgggugcuucgaguucuaccacaagugcaacgacgagugcauggaguccgugaagaacggcaccuacgacuaccccaaguacucggaggaguccaagcugaacaaggagaagaucgacggggugaagcucgagagcaugggcguguaccagauccuggccaucuacuccaccguggccagcucgcugguccuccuggugucccugggcgccaucagcuucuggaugugcuccaacgggagccuccagugccgcaucugcaucuga

SEQ ID NO: 3873 - RNA, 1701 nt, Artificial Sequence; identical to SEQ ID NO: 62
  derived and/or modified CDS sequence (AUadapt) from InfluenzaA__ACZ16040__HA

SEQ ID NO: 3874 - RNA, 1701 nt, Artificial Sequence; identical to SEQ ID NO: 62
  derived and/or modified CDS sequence (AUadapt) from InfluenzaA__ACZ16050__HA

SEQ ID NO: 3875 - RNA, 1701 nt, Artificial Sequence; identical to SEQ ID NO: 62
  derived and/or modified CDS sequence (AUadapt) from InfluenzaA__ACZ16060__HA

SEQ ID NO: 3876 - RNA, 1701 nt, Artificial Sequence
  derived and/or modified CDS sequence (AUadapt) from InfluenzaA__ACZ16070__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugagccugcuggaggacaagcacaacgggaagcucugcaagcugcgcggcgucgcgccccugcaccucgggaagugcaacaucgccggcuggauccuggggaacccggagugcgagucccugucgaccgcguccagcugguccuacaucguggagaccucguccagcgacaacggcacgugcuaccccggcgacuucaucgacuacgaggagcuccgggagcagcuguccucgguguccagcuucgagcgcuucgagaucuuccccaagaccuccucguggcccaaccacgacuccaacaagggggucaccgccgccugcccgcacgccggcgccaagagcuucuacaagaaccugaucuggcucgugaagaaggggaacuccuaccccaagcugucgaagagcuacaucaacgacaagggcaaggaggugcugguccucugggggauccaccaccccuccaccagcgccgaccagcagucccuguaccagaacgccgacgccuacguguucgugggcucgucccgguacagcaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccggguccggcaucaucaucucggacacccccgugcacgacugcaacacgaccugccagaccccgaagggcgccaucaacaccucccugcccuuccagaacauccaccccaucacgaucgggaagugccccaaguacgucaagagcaccaagcugcggcucgcgaccggccugcgcaacgugccguccauccagucgcgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgacccgcaucuaccagauccuggcgaucuacagcaccgucgccuccucgcuggugcucguggucucccugggggccaucagcuucuggaugugcuccaacggcagccugcagugccggaucugcaucuga

SEQ ID NO: 3877 - RNA, 1701 nt, Artificial Sequence
  derived and/or modified CDS sequence (AUadapt) from InfluenzaA__ACZ16080__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgacgggucgggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgccaccggccugcgcaacgucccgucgauccagucccgggggcuguucggcgcgaucgccggguucaucgagggcggcuggaccgggaugguggacggcugguacggguaccaccaccagaacgagcagggcagcggguacgccgccgaccucaaguccacgcagaacgccaucgacgagaucaccaacaaggugaacucggucaucgagaagaugaacacccaguucaccgcggugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggccaucuacagcaccgucgcgucgucccuggugcucguggucagccugggggccaucuccuucuggaugugcagcaacggcucccugcagugccggaucugcaucuga

SEQ ID NO: 3878 - RNA, 1701 nt, Artificial Sequence
  derived and/or modified CDS sequence (AUadapt) from InfluenzaA__ACZ16090__HA
augaaggccauccugcucgugcugcuguacaccuucgccaccgcgaacgccgacacgcucugcaucggcuaccacgccaacaacucgaccgacaccgucgacaccgugcuggagaagaacgugacggucacccacuccgugaaccugcucgaggacaagcacaacgggaagcugugcaagcugcgcggcguggcgccccuccaccuggggaagugcaacaucgccggcuggauccuggggaacccggagugcgagagccucuccaccgccucguccuggagcuacaucgucgagaccuccucguccgacaacggcacgugcuaccccggcgacuucaucgacuacgaggagcugcgggagcagcugagcuccaugucguccuucgagcgcuucgagaucuuccccaagaccagcuccuggcccaaccacgacucgaacaagggggugaccgccgccugcccgcacgccggcgcgaaguccuucuacaagaaccucaucuggcuggugaagaaggggaacagcuaccccaagcuguccaagucguacaucaacgacaagggcaaggagguccucgugcugugggggauccaccaccccagcaccuccgccgaccagcagucgcuguaccagaacgccgacgccuacguguucgucggcuccagccgguacuccaagaaguucaagcccgagaucgccauccgcccgaaggugcgggaccaggagggccgcaugaacuacuacuggacgcucguggagcccggggacaagaucaccuucgaggcgaccggcaaccuggucgugccccgguacgccuucgccauggagcgcaacgccgggucgggcaucaucaucuccgacacccccgugcacgacugcaacacgaccugccagaccccgaagggcgccaucaacaccagccugcccuuccagaacauccaccccaucacgaucgggaagugccccaaguacgucaaguccaccaagcuccggcuggcgaccggccugcgcaacgugccgucgauccagucccggggccucuucggggccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggucaacucggugaucgagaagaugaacacccaguucaccgccgugggcaaggaguucaaccaccuggagaagcgcaucgagaaccucaacaagaaggucgacgacggcuuccuggacaucuggacguacaacgccgagcugcucgugcugcuggagaacgagcggacccucgacuaccacgacuccaacgucaagaaccuguacgagaaggugcgcagccagcugaagaacaacgccaaggagaucgggaacggcugcuucgaguucuaccacaagugcgacaacacgugcauggaguccgugaagaacgggaccuacgacuaccccaaguacucggaggaggccaagcucaaccgggaggagaucgacggcgucaagcuggaguccacccgcaucuaccagauccuggcgaucuacagcaccguggccucgucccucgugcuggucgugagccugggggccaucuccuucuggaugugcagcaacggcucccuccagugccggaucugcaucuga

SEQ ID NO: 3879 - RNA, 1701 nt, Artificial Sequence; identical to SEQ ID NO: 62
  derived and/or modified CDS sequence (AUadapt) from InfluenzaA__ACZ16100__HA

SEQ ID NO: 3880 - RNA, 1701 nt, Artificial Sequence; identical to SEQ ID NO: 62
  derived and/or modified CDS sequence (AUadapt) from InfluenzaA__ACZ16110__HA

SEQ ID NO: 3881 - RNA, 1701 nt, Artificial Sequence; identical to SEQ ID NO: 62
  derived and/or modified CDS sequence (AUadapt) from InfluenzaA__ACZ16120__HA

SEQ ID NO: 3882 - RNA, 1701 nt, Artificial Sequence; identical to SEQ ID NO: 3649
  derived and/or modified CDS sequence (AUadapt) from InfluenzaA__ACZ16130__HA

SEQ ID NO: 3883 - RNA, 1701 nt, Artificial Sequence; identical to SEQ ID NO: 62
  derived and/or modified CDS sequence (AUadapt) from InfluenzaA__ACZ16140__HA

SEQ ID NO: 3884 - RNA, 1701 nt, Artificial Sequence; identical to SEQ ID NO: 62
  derived and/or modified CDS sequence (AUadapt) from InfluenzaA__ACZ16150__HA

SEQ ID NO: 3885 - RNA, 1701 nt, Artificial Sequence; identical to SEQ ID NO: 62
  derived and/or modified CDS sequence (AUadapt) from InfluenzaA__ACZ16160__HA

SEQ ID NO: 3886 - RNA, 1701 nt, Artificial Sequence; identical to SEQ ID NO: 96
  derived and/or modified CDS sequence (AUadapt) from InfluenzaA__ACZ16170__HA

SEQ ID NO: 3887 - RNA, 1701 nt, Artificial Sequence
  derived and/or modified CDS sequence (AUadapt) from InfluenzaA__ACZ16180__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguacaccgcguccucgugguccuacaucguggagaccagcuccucggacaacggcacgugcuaccccggcgacuucaucgacuacgaggagcuccgggagcagcuguccagcguguccucguucgagcgcuucgagaucuuccccaagaccuccagcuggcccaaccacgacuccaacaagggggucaccgccgccugcccgcacgccggcgccaagucguucuacaagaaccugaucuggcucgugaagaaggggaacuccuaccccaagcugagcaaguccuacaucaacgacaagggcaaggaggugcugguccucugggggauccaccaccccucgaccagcgccgaccagcagucccuguaccagaacgccgacgccuacguguucgugggcucgucccgguacagcaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccggguccggcaucaucaucucggacacccccgugcacgacugcaacacgaccugccagaccccgaagggcgccaucaacaccucccugcccuuccagaacauccaccccaucacgaucgggaagugccccaaguacgucaagagcaccaagcugcggcucgcgaccggccugcgcaacgugccguccauccagucgcgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgacccgcaucuaccagauccuggcgaucuacuccaccgucgccagcucgcuggugcucguggucucccugggggccaucagcuucuggaugugcuccaacggcagccugcagugccggaucugcaucuga

SEQ ID NO: 3888 - RNA, 1701 nt, Artificial Sequence; identical to SEQ ID NO: 62
  derived and/or modified CDS sequence (AUadapt) from InfluenzaA__ACZ16190__HA

SEQ ID NO: 3889 - RNA, 1701 nt, Artificial Sequence
  derived and/or modified CDS sequence (AUadapt) from InfluenzaA__ACZ16200__HA
augaaggccauccuggugguccuccuguacaccuucgccaccgcgaaccccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgccccgcugcaccucgggaagugcaacaucgccggcuggauccuggggaaccccgagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggccgaaccacgacucgaacaagggggucaccgcggccugcccccacgccggcgccaaguccuucuacaagaaccugaucuggcucgugaagaaggggaacagcuaccccaagcuguccaagucguacaucaacgacaagggcaaggaggugcugguccucugggggauccaccaccccagcaccuccgcggaccagcagucgcuguaccagaacgccgacgccuacguguucgugggcuccagccgguacuccaagaaguucaagccggagaucgccauccgccccaagguccgggaccaggagggccgcaugaacuacuacuggacgcugguggagcccggggacaagaucaccuucgaggccaccggcaaccucguggucccccgguacgcguucgccauggagcgcaacgccgggucgggcaucaucaucuccgacaccccggugcacgacugcaacacgaccugccagacccccaagggcgccaucaacaccagccugcccuuccagaacauccaccccaucacgaucgggaagugcccgaaguacgugaaguccaccaagcugcggcucgccaccggccugcgcaacguccccucgauccagucccgggggcuguucggcgcgaucgccggguucaucgagggcggcuggaccgggaugguggacggcugguacggguaccaccaccagaacgagcagggcagcggguacgccgccgaccucaaguccacgcagaacgccaucgacgagaucaccaacaaggugaacucggucaucgagaagaugaacacccaguucaccgcggugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggccaucuacagcaccgucgcgucgucccuggugcucguggucagccugggggccaucuccuucuggaugugcagcaacggcucccugcagugccggaucugcaucuga

SEQ ID NO: 3890 - RNA, 1701 nt, Artificial Sequence; identical to SEQ ID NO: 62
  derived and/or modified CDS sequence (AUadapt) from InfluenzaA__ACZ16210__HA

SEQ ID NO: 3891 - RNA, 1701 nt, Artificial Sequence; identical to SEQ ID NO: 62
  derived and/or modified CDS sequence (AUadapt) from InfluenzaA__ACZ16220__HA

SEQ ID NO: 3892 - RNA, 1701 nt, Artificial Sequence; identical to SEQ ID NO: 3649
  derived and/or modified CDS sequence (AUadapt) from InfluenzaA__ACZ16230__HA

SEQ ID NO: 3893 - RNA, 1701 nt, Artificial Sequence
  derived and/or modified CDS sequence (AUadapt) from InfluenzaA__ACZ16240__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccucguccuggagcuacaucguggagaccuccucguccgacaacggcacgugcuaccccggcgacuucaucgacuacgaggagcugcgggagcagcucagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcuggugaagaaggggaacagcuaccccaagcucuccaagucguacaucaacgacaagggcaaggaggugcugguccugugggggauccaccaccccagcaccuccgccgaccagcagucgcucuaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggucgggcaucaucaucuccgacacccccgugcacgacugcaacacgaccugccagaccccgaagggcgccaucaacaccagccuccccuuccagaacauccaccccaucacgaucgggaagugccccaaguacgugaaguccaccaagcugcggcuggcgaccggccuccgcaacgucccgucgauccagucccgggggcuguucggcgccaucgccggguucaucgagggcggcuggaccgggaugguggacggcugguacggguaccaccaccagaacgagcagggcagcggguacgccgccgaccugaaguccacgcagaacgcgcucgacgagaucaccaacaaggugaacucggucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 3894 - RNA, 1701 nt, Artificial Sequence; identical to SEQ ID NO: 62
  derived and/or modified CDS sequence (AUadapt) from InfluenzaA__ACZ16260__HA

SEQ ID NO: 3895 - RNA, 1701 nt, Artificial Sequence
  derived and/or modified CDS sequence (AUadapt) from InfluenzaA__ACZ16270__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagaaccuguaccagaacgccgacgccuacguguucgugggcagcucccgguacucgaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucacgaucgggaagugccccaaguacgucaagucgaccaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagucgacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccugauccucguggugucccugggggccaucucguucuggaugugcuccaacggcagccugcagugccggaucugcaucuga

SEQ ID NO: 3896 - RNA, 1701 nt, Artificial Sequence; identical to SEQ ID NO: 3576
  derived and/or modified CDS sequence (AUadapt) from InfluenzaA__ACZ16280__HA

SEQ ID NO: 3897 - RNA, 1701 nt, Artificial Sequence; identical to SEQ ID NO: 62
  derived and/or modified CDS sequence (AUadapt) from InfluenzaA__ACZ16290__HA

SEQ ID NO: 3898 - RNA, 1701 nt, Artificial Sequence
  derived and/or modified CDS sequence (AUadapt) from InfluenzaA__ACZ16300__HA
augaaggccauccuggugguccuccuguacaccuucgccaccgcgaacgccgacacgcugugcaucggcuaccacgccaacaacucgaccgacaccguggacaccgugcucgagaagaacgucaucgugacgcacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacgggaccugcuaccccggcgacuucaucgacuacgaggagcuccgggagcagcugagcuccgugucguccuucgagcgcuucgagaucuuccccaagacgagcuccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcuccucgcgguacuccaagaaguucaagcccgagaucgccauccgcccgaagguccgggaccaggagggccgcaugaacuacuacuggacccugguggagcccggggacaagaucacguucgaggcgaccggcaaccuccuggugccccgguacgccuucgccauggagcgcaacgccgggagcggcaucaucaucuccgacacccccguccacgacugcaacaccacgugccagaccccgaagggcgccaucaacaccucgcugcccuuccagaacauccaccccaucaccaucgggaagugccccaaguacgugaaguccacgaagcuccggcuggcgaccggccugcgcaacgugccgagcauccagucccggggccucuucggcgccaucgccggguucaucgagggcggcuggaccgggauggucgacggcugguacggguaccaccaccagaacgagcagggcagcggguacgccgccgaccugaaguccacccagaacgcgaucgacgagaucacgaacaaggugaacucggugaucgagaagaugaacacccaguucaccgccgucggcaaggaguucaaccaccuggagaagcgcaucgagaaccucaacaagaagguggacgacggcuuccuggacaucuggaccuacaacgccgagcugcucguccugcuggagaacgagcggacgcucgacuaccacgacuccaacgugaagaaccuguacgagaaggugcgcagccagcugaagaacaacgccaaggagaucgggaacggcugcuucgaguucuaccacaagugcgacaacacgugcauggaguccgucaagaacgggaccuacgacuaccccaaguacucggaggaggccaagcucaaccgggaggagaucgacggcgugaagcuggaguccacccgcaucuaccagauccuggcgaucuacagcaccguggccucgucccucguccugguggugagccugggggccaucuccuucuggaugugcagcaacggcucccuccagugccggaucugcaucuga

SEQ ID NO: 3899 - RNA, 1701 nt, Artificial Sequence; identical to SEQ ID NO: 3644
  derived and/or modified CDS sequence (AUadapt) from InfluenzaA__ACZ16310__HA

SEQ ID NO: 3900 - RNA, 1701 nt, Artificial Sequence
  derived and/or modified CDS sequence (AUadapt) from InfluenzaA__ACZ16320__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccagaacauccaccccaucacgaucgggaagugccccaaguacgugaaguccacccggcugcgccucgcgaccggccugcggaacgucccgucgauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgcgaggagaucgacggcgugaagcucgaguccacccggaucuaccagauccuggcgaucuacagcaccgucgccucgucccuggugcucguggucagccugggggccaucuccuucuggaugugcagcaacggcucccugcagugccgcaucugcaucuga

SEQ ID NO: 3901 - RNA, 1701 nt, Artificial Sequence; identical to SEQ ID NO: 3644
  derived and/or modified CDS sequence (AUadapt) from InfluenzaA__ACZ16330__HA

SEQ ID NO: 3902 - RNA, 1701 nt, Artificial Sequence; identical to SEQ ID NO: 96
  derived and/or modified CDS sequence (AUadapt) from InfluenzaA__ACZ16340__HA

SEQ ID NO: 3903 - RNA, 1701 nt, Artificial Sequence; identical to SEQ ID NO: 62
  derived and/or modified CDS sequence (AUadapt) from InfluenzaA__ACZ16350__HA

SEQ ID NO: 3904 - RNA, 1701 nt, Artificial Sequence; identical to SEQ ID NO: 62
  derived and/or modified CDS sequence (AUadapt) from InfluenzaA__ACZ16360__HA

SEQ ID NO: 3905 - RNA, 1701 nt, Artificial Sequence; identical to SEQ ID NO: 96
  derived and/or modified CDS sequence (AUadapt) from InfluenzaA__ACZ16370__HA

SEQ ID NO: 3906 - RNA, 1701 nt, Artificial Sequence; identical to SEQ ID NO: 62
  derived and/or modified CDS sequence (AUadapt) from InfluenzaA__ACZ16380__HA

SEQ ID NO: 3907 - RNA, 1701 nt, Artificial Sequence; identical to SEQ ID NO: 62
  derived and/or modified CDS sequence (AUadapt) from InfluenzaA__ACZ16390__HA

SEQ ID NO: 3908 - RNA, 1701 nt, Artificial Sequence; identical to SEQ ID NO: 62
  derived and/or modified CDS sequence (AUadapt) from InfluenzaA__ACZ16400__HA

SEQ ID NO: 3909 - RNA, 1701 nt, Artificial Sequence; identical to SEQ ID NO: 62
  derived and/or modified CDS sequence (AUadapt) from InfluenzaA__ACZ16410__HA

SEQ ID NO: 3910 - RNA, 1701 nt, Artificial Sequence; identical to SEQ ID NO: 3538
  derived and/or modified CDS sequence (AUadapt) from InfluenzaA__ACZ16420__HA

SEQ ID NO: 3911 - RNA, 1701 nt, Artificial Sequence; identical to SEQ ID NO: 62
  derived and/or modified CDS sequence (AUadapt) from InfluenzaA__ACZ16430__HA

SEQ ID NO: 3912 - RNA, 1701 nt, Artificial Sequence; identical to SEQ ID NO: 62
  derived and/or modified CDS sequence (AUadapt) from InfluenzaA__ACZ16440__HA

SEQ ID NO: 3913 - RNA, 1701 nt, Artificial Sequence
  derived and/or modified CDS sequence (AUadapt) from InfluenzaA__ACZ16450__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgcuggugaagcccggggacaagaucaccuucgaggcgaccggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 3914 - RNA, 1701 nt, Artificial Sequence; identical to SEQ ID NO: 96
  derived and/or modified CDS sequence (AUadapt) from InfluenzaA__ACZ16460__HA

SEQ ID NO: 3915 - RNA, 1701 nt, Artificial Sequence; identical to SEQ ID NO: 62
  derived and/or modified CDS sequence (AUadapt) from InfluenzaA__ACZ16470__HA

SEQ ID NO: 3916 - RNA, 1701 nt, Artificial Sequence; identical to SEQ ID NO: 62
  derived and/or modified CDS sequence (AUadapt) from InfluenzaA__ACZ16480__HA

SEQ ID NO: 3917 - RNA, 1701 nt, Artificial Sequence; identical to SEQ ID NO: 3649
  derived and/or modified CDS sequence (AUadapt) from InfluenzaA__ACZ16490__HA

SEQ ID NO: 3918 - RNA, 1701 nt, Artificial Sequence; identical to SEQ ID NO: 62
  derived and/or modified CDS sequence (AUadapt) from InfluenzaA__ACZ16500__HA

SEQ ID NO: 3919 - RNA, 1701 nt, Artificial Sequence; identical to SEQ ID NO: 96
  derived and/or modified CDS sequence (AUadapt) from InfluenzaA__ACZ16510__HA

SEQ ID NO: 3920 - RNA, 1701 nt, Artificial Sequence; identical to SEQ ID NO: 62
  derived and/or modified CDS sequence (AUadapt) from InfluenzaA__ACZ16530__HA

SEQ ID NO: 3921 - RNA, 1701 nt, Artificial Sequence
  derived and/or modified CDS sequence (AUadapt) from InfluenzaA__ACZ16540__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccagcuccgacaacggcacgugcuaccccggcgacuucaucgacuacgaggagcugcgggagcagcucucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcuggugaagaaggggaacucguaccccaagcucuccaagagcuacaucaacgacaagggcaaggaggugcugguccugugggggauccaccaccccucgaccuccgccgaccagcagagccucuaccagaacgccgacgccuacguguucgugggcuccucgcgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggagcggcaucaucaucuccgacacccccgugcacgacugcaacacgaccugccagaccccgaagggcgccaucaacaccucgcuccccuuccagaacauccaccccaucacgaucgggaagugccccaaguacgugaaguccaccaagcugcggcuggcgaccggccuccgcaacgucccgagcauccagucccgggggcugcugggcgccaucgccggguucaucgagggcggcuggaccgggaugguggacggcugguacggguaccaccaccagaacgagcagggcucgggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccagcucccuggugcucguggucucgcugggggccaucuccuucuggaugugcagcaacggcucccugcagugccggaucugcaucuga

SEQ ID NO: 3922 - RNA, 1701 nt, Artificial Sequence; identical to SEQ ID NO: 3644
  derived and/or modified CDS sequence (AUadapt) from InfluenzaA__ACZ16550__HA

SEQ ID NO: 3923 - RNA, 1701 nt, Artificial Sequence; identical to SEQ ID NO: 62
  derived and/or modified CDS sequence (AUadapt) from InfluenzaA__ACZ16583__HA

SEQ ID NO: 3924 - RNA, 1701 nt, Artificial Sequence; identical to SEQ ID NO: 3644
  derived and/or modified CDS sequence (AUadapt) from InfluenzaA__ACZ16593__HA

SEQ ID NO: 3925 - RNA, 1701 nt, Artificial Sequence; identical to SEQ ID NO: 62
  derived and/or modified CDS sequence (AUadapt) from InfluenzaA__ACZ16603__HA

SEQ ID NO: 3926 - RNA, 1701 nt, Artificial Sequence; identical to SEQ ID NO: 3644
  derived and/or modified CDS sequence (AUadapt) from InfluenzaA__ACZ16630__HA

SEQ ID NO: 3927 - RNA, 1701 nt, Artificial Sequence; identical to SEQ ID NO: 62
  derived and/or modified CDS sequence (AUadapt) from InfluenzaA__ACZ16640__HA

SEQ ID NO: 3928 - RNA, 1701 nt, Artificial Sequence; identical to SEQ ID NO: 62
  derived and/or modified CDS sequence (AUadapt) from InfluenzaA__ACZ16650__HA

SEQ ID NO: 3929 - RNA, 1701 nt, Artificial Sequence; identical to SEQ ID NO: 62
  derived and/or modified CDS sequence (AUadapt) from InfluenzaA__ACZ16660__HA

SEQ ID NO: 3930 - RNA, 1701 nt, Artificial Sequence; identical to SEQ ID NO: 62
  derived and/or modified CDS sequence (AUadapt) from InfluenzaA__ACZ16670__HA

SEQ ID NO: 3931 - RNA, 1701 nt, Artificial Sequence; identical to SEQ ID NO: 62
  derived and/or modified CDS sequence (AUadapt) from InfluenzaA__ACZ16680__HA

SEQ ID NO: 3932 - RNA, 1701 nt, Artificial Sequence; identical to SEQ ID NO: 62
  derived and/or modified CDS sequence (AUadapt) from InfluenzaA__ACZ16690__HA

SEQ ID NO: 3933 - RNA, 1701 nt, Artificial Sequence; identical to SEQ ID NO: 62
  derived and/or modified CDS sequence (AUadapt) from InfluenzaA__ACZ16700__HA

SEQ ID NO: 3934 - RNA, 1701 nt, Artificial Sequence; identical to SEQ ID NO: 62
  derived and/or modified CDS sequence (AUadapt) from InfluenzaA__ACZ16710__HA

SEQ ID NO: 3935 - RNA, 1701 nt, Artificial Sequence; identical to SEQ ID NO: 62
  derived and/or modified CDS sequence (AUadapt) from InfluenzaA__ACZ16720__HA

SEQ ID NO: 3936 - RNA, 1701 nt, Artificial Sequence; identical to SEQ ID NO: 3644
  derived and/or modified CDS sequence (AUadapt) from InfluenzaA__ACZ16730__HA

SEQ ID NO: 3937 - RNA, 1701 nt, Artificial Sequence; identical to SEQ ID NO: 3644
  derived and/or modified CDS sequence (AUadapt) from InfluenzaA__ACZ16740__HA

SEQ ID NO: 3938 - RNA, 1701 nt, Artificial Sequence; identical to SEQ ID NO: 62
  derived and/or modified CDS sequence (AUadapt) from InfluenzaA__ACZ16750__HA

SEQ ID NO: 3939 - RNA, 1701 nt, Artificial Sequence; identical to SEQ ID NO: 62
  derived and/or modified CDS sequence (AUadapt) from InfluenzaA__ACZ16760__HA

SEQ ID NO: 3940 - RNA, 1701 nt, Artificial Sequence; identical to SEQ ID NO: 96
  derived and/or modified CDS sequence (AUadapt) from InfluenzaA__ACZ16770__HA

SEQ ID NO: 3941 - RNA, 1701 nt, Artificial Sequence; identical to SEQ ID NO: 62
  derived and/or modified CDS sequence (AUadapt) from InfluenzaA__ACZ16780__HA

SEQ ID NO: 3942 - RNA, 1701 nt, Artificial Sequence; identical to SEQ ID NO: 62
  derived and/or modified CDS sequence (AUadapt) from InfluenzaA__ACZ16790__HA

SEQ ID NO: 3943 - RNA, 1701 nt, Artificial Sequence; identical to SEQ ID NO: 62
  derived and/or modified CDS sequence (AUadapt) from InfluenzaA__ACZ16800__HA

SEQ ID NO: 3944 - RNA, 1701 nt, Artificial Sequence; identical to SEQ ID NO: 62
  derived and/or modified CDS sequence (AUadapt) from InfluenzaA__ACZ16810__HA

SEQ ID NO: 3945 - RNA, 1701 nt, Artificial Sequence; identical to SEQ ID NO: 3576
  derived and/or modified CDS sequence (AUadapt) from InfluenzaA__ACZ16820__HA

SEQ ID NO: 3946 - RNA, 1701 nt, Artificial Sequence; identical to SEQ ID NO: 62
  derived and/or modified CDS sequence (AUadapt) from InfluenzaA__ACZ16830__HA

SEQ ID NO: 3947 - RNA, 1701 nt, Artificial Sequence
  derived and/or modified CDS sequence (AUadapt) from InfluenzaA__ACZ16840__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcacgaagguccgggaccaggagggccgcaugaacuacuacuggacccugguggagccgggggacaagaucaccuucgaggcgaccggcaaccucguggucccccgguacgccuucgccauggagcgcaacgccgggucgggcaucaucaucuccgacacgcccgugcacgacugcaacacgaccugccagacccccaagggcgccaucaacaccagccugccguuccagaacauccaccccaucaccaucgggaagugccccaaguacgugaaguccaccaagcugcggcucgcgaccggccugcgcaacguccccucgauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacucggucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuacccgaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 3948 - RNA, 1701 nt, Artificial Sequence; identical to SEQ ID NO: 62
  derived and/or modified CDS sequence (AUadapt) from InfluenzaA__ACZ16850__HA

SEQ ID NO: 3949 - RNA, 1701 nt, Artificial Sequence
  derived and/or modified CDS sequence (AUadapt) from InfluenzaA__ACZ16860__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcuccucgcgguacuccaagaaguucaagcccgagaucgccauccgcccgaagguccgggaccaggagggccgcaugaacuacuacuggacgcugguggagcccggggacaagaucaccuucgaggcgaccggcaaccucguggcgccccgguacgccuucgccauggagcgcaacgccgggagcggcaucaucaucuccgacacccccguccacgacugcaacacgaccugccagaccccgaagggcgccaucaacaccucgcugcccuuccagaacauccaccccaucacgaucgggaagugccccaaguacgugaaguccaccaagcugcggcucgccaccggccugcgcaacgugccgagcauccagucccgggggcuguucggcgccaucgccggguucaucgagggcggcuggaccgggauggucgacggcugguacggguaccaccaccagaacgagcagggcucgggguacgccgcggaccucaaguccacgcagaacgccaucgacgagaucaccaacaaggugaacagcgugaucgagaagaugaacacccaguucaccgccgucggcaaggaguucaaccaccuggagaagcgcaucgagaaccugaacaagaagguggacgacggcuuccucgacaucuggacguacaacgccgagcugcugguccuccuggagaacgagcggacccuggacuaccacgacuccaacgugaagaaccucuacgagaaggugcgcucgcagcugaagaacaacgccaaggagaucgggaacggcugcuucgaguucuaccacaagugcgacaacacgugcauggaguccgucaagaacgggaccuacgacuaccccaaguacagcgaggaggcgaagcugaaccgggaggagaucgacggcgugaagcucgaguccacccgcaucuaccagauccuggccaucuacucgaccguggccagcucccugguccucguggugucgcugggggccaucuccuucuggaugugcagcaacggcucccugcagugccggaucugcaucuga

SEQ ID NO: 3950 - RNA, 1701 nt, Artificial Sequence; identical to SEQ ID NO: 3644
  derived and/or modified CDS sequence (AUadapt) from InfluenzaA__ACZ16870__HA

SEQ ID NO: 3951 - RNA, 1701 nt, Artificial Sequence
  derived and/or modified CDS sequence (AUadapt) from InfluenzaA__ACZ16880__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgacgggucgggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgccaccggccugcgcaacgucccgucgauccagucccgggggcuguucggcgcgaucgccggguucaucgagggcggcuggaccgggaugguggacggcugguacggguaccaccaccagaacgagcagggcagcggguacgccgccgaccucaaguccacgcagaacgccaucgacgagaucaccaacaaggugaacucggucaucgagaagaugaacacccaguucaccgcggugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcaacaacacgugcauggaguccgugaagaacgggaccuacgacuaccccaaguacucggaggaggccaagcugaaccgggaggagaucgacggcgugaagcucgaguccacccgcaucuaccagauccuggccaucuacagcaccgucgcgucgucccuggugcucguggucagccugggggccaucuccuucuggaugugcagcaacggcucccugcagugccggaucugcaucuga

SEQ ID NO: 3952 - RNA, 1701 nt, Artificial Sequence; identical to SEQ ID NO: 3649
  derived and/or modified CDS sequence (AUadapt) from InfluenzaA__ACZ16890__HA

SEQ ID NO: 3953 - RNA, 1701 nt, Artificial Sequence; identical to SEQ ID NO: 62
  derived and/or modified CDS sequence (AUadapt) from InfluenzaA__ACZ16900__HA

SEQ ID NO: 3954 - RNA, 1701 nt, Artificial Sequence; identical to SEQ ID NO: 62
  derived and/or modified CDS sequence (AUadapt) from InfluenzaA__ACZ16910__HA

SEQ ID NO: 3955 - RNA, 1701 nt, Artificial Sequence; identical to SEQ ID NO: 62
  derived and/or modified CDS sequence (AUadapt) from InfluenzaA__ACZ16920__HA

SEQ ID NO: 3956 - RNA, 1701 nt, Artificial Sequence; identical to SEQ ID NO: 116
  derived and/or modified CDS sequence (AUadapt) from InfluenzaA__ACZ16930__HA

SEQ ID NO: 3957 - RNA, 1701 nt, Artificial Sequence; identical to SEQ ID NO: 116
  derived and/or modified CDS sequence (AUadapt) from InfluenzaA__ACZ16940__HA

SEQ ID NO: 3958 - RNA, 1701 nt, Artificial Sequence; identical to SEQ ID NO: 62
  derived and/or modified CDS sequence (AUadapt) from InfluenzaA__ACZ16950__HA

SEQ ID NO: 3959 - RNA, 1701 nt, Artificial Sequence; identical to SEQ ID NO: 3156
  derived and/or modified CDS sequence (AUadapt) from InfluenzaA__ACZ16960__HA

SEQ ID NO: 3960 - RNA, 1701 nt, Artificial Sequence
  derived and/or modified CDS sequence (AUadapt) from InfluenzaA__ACZ16970__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaaggaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 3961 - RNA, 1701 nt, Artificial Sequence; identical to SEQ ID NO: 116
  derived and/or modified CDS sequence (AUadapt) from InfluenzaA__ACZ16980__HA

SEQ ID NO: 3962 - RNA, 1701 nt, Artificial Sequence; identical to SEQ ID NO: 116
  derived and/or modified CDS sequence (AUadapt) from InfluenzaA__ACZ17000__HA

SEQ ID NO: 3963 - RNA, 1701 nt, Artificial Sequence
  derived and/or modified CDS sequence (AUadapt) from InfluenzaA__ACZ17010__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagcaaguacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggucgggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgucgauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacaagaucaccaacaaggugaacucggucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgcgaggagaucgacggcgugaagcucgaguccacccggaucuaccagauccuggcgaucuacagcaccgucgccucgucccuggugcucguggucagccugggggccaucuccuucuggaugugcagcaacggcucccugcagugccgcaucugcaucuga

SEQ ID NO: 3964 - RNA, 1701 nt, Artificial Sequence; identical to SEQ ID NO: 116
  derived and/or modified CDS sequence (AUadapt) from InfluenzaA__ACZ17020__HA

SEQ ID NO: 3965 - RNA, 1701 nt, Artificial Sequence
  derived and/or modified CDS sequence (AUadapt) from InfluenzaA__ACZ17030__HA
augaaggccacccuggugguccuccuguacaccuucgccacggcgaacgccgacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggaggccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggucaccgccgccugcccgcacgcgggcgccaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgcgauccgcccgaagguccgggaccaggagggccgcaugaacuacuacuggacccugguggagcccggggacaagaucaccuucgaggccaccggcaaccucguggucccccgguacgccuucgccauggagcgcaacgccggguccggcaucaucaucucggacacgcccgugcacgacugcaacacgaccugccagaccccgaagggcgcgaucaacaccucccugcccuuccagaacauccaccccaucaccaucgggaagugccccaaguacgucaagagcaccaagcugcggcucgccaccggccugcgcaacgugccguccauccagucgcgggggcuguucggcgccaucgccggguucaucgagggcggcuggacggggaugguggacggcugguacggguaccaccaccagaacgagcagggcuccggguacgccgcggaccucaagucgacccagaacgccaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggcgaagcugaaccgggaggagaucgacggcgugaagcucgagagcacccgcaucuaccagauccuggccaucuacuccaccgucgccucgagccuggugcucguggucucccugggggccaucucguucuggaugugcuccaacggcagccugcagugccggaucugcaucuga

SEQ ID NO: 3966 - RNA, 1701 nt, Artificial Sequence
  derived and/or modified CDS sequence (AUadapt) from InfluenzaA__ACZ17040__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccaaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 3967 - RNA, 1701 nt, Artificial Sequence; identical to SEQ ID NO: 116
  derived and/or modified CDS sequence (AUadapt) from InfluenzaA__ACZ17050__HA

SEQ ID NO: 3968 - RNA, 1701 nt, Artificial Sequence; identical to SEQ ID NO: 116
  derived and/or modified CDS sequence (AUadapt) from InfluenzaA__ACZ17060__HA

SEQ ID NO: 3969 - RNA, 1701 nt, Artificial Sequence; identical to SEQ ID NO: 116
  derived and/or modified CDS sequence (AUadapt) from InfluenzaA__ACZ17070__HA

SEQ ID NO: 3970 - RNA, 1701 nt, Artificial Sequence; identical to SEQ ID NO: 96
  derived and/or modified CDS sequence (AUadapt) from InfluenzaA__ACZ17080__HA

SEQ ID NO: 3971 - RNA, 1701 nt, Artificial Sequence
  derived and/or modified CDS sequence (AUadapt) from InfluenzaA__ACZ17090__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcugggggacaagcacaacggcaagcucugcaagcugcgcggggucgcgccccugcaccucggcaagugcaacaucgccggguggauccugggcaacccggagugcgagucgcuguccaccgccagcuccuggucguacaucguggagaccuccagcuccgacaacggcacgugcuaccccggggacuucaucgacuacgaggagcuccgggagcagcugucguccgugagcuccuucgagcgcuucgagaucuuccccaagaccucguccuggcccaaccacgacagcaacaagggcgucaccgccgccugcccgcacgccggggcgaaguccuucuacaagaaccugaucuggcucgugaagaagggcaacucguaccccaagcuguccaagagcuacaucaacgacaaggggaaggaggugcugguccucuggggcauccaccaccccucgaccuccgccgaccagcagagccuguaccagaacgccgacgccuacguguucgugggcacgucccgguacucgaagaaguucaagcccgagaucgccauccgcccgaagguccgggaccaggaggggcgcaugaacuacuacuggacccugguggagcccggcgacaagaucaccuucgaggcgaccgggaaccucguggucccccgguacgccuucgccauggagcgcaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagucgaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaaggucaagucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgcgaggagaucgacggggugaagcucgagagcacccggaucuaccagauccuggcgaucuacuccaccgucgccucgagccuggugcucguggucucccugggcgccaucucguucuggaugugcuccaacggcagccugcagugccgcaucugcaucuga

SEQ ID NO: 3972 - RNA, 1701 nt, Artificial Sequence; identical to SEQ ID NO: 62
  derived and/or modified CDS sequence (AUadapt) from InfluenzaA__ACZ17100__HA

SEQ ID NO: 3973 - RNA, 1701 nt, Artificial Sequence
  derived and/or modified CDS sequence (AUadapt) from InfluenzaA__ACZ17110__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccgagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 3974 - RNA, 1701 nt, Artificial Sequence
  derived and/or modified CDS sequence (AUadapt) from InfluenzaA__ACZ17120__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaccaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 3975 - RNA, 1701 nt, Artificial Sequence
  derived and/or modified CDS sequence (AUadapt) from InfluenzaA__ACZ17130__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacgcccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggcgaagcugaaccgggaggagaucgacggcgugaagcucgagagcacccgcaucuaccagauccuggccaucuacuccaccgucgccucgagccuggugcucguggucucccugggggccaucucguucuggaugugcuccaacggcagccugcagugccggaucugcaucuga

SEQ ID NO: 3976 - RNA, 1701 nt, Artificial Sequence; identical to SEQ ID NO: 3712
  derived and/or modified CDS sequence (AUadapt) from InfluenzaA__ACZ17140__HA

SEQ ID NO: 3977 - RNA, 1701 nt, Artificial Sequence; identical to SEQ ID NO: 3543
  derived and/or modified CDS sequence (AUadapt) from InfluenzaA__ACZ17150__HA

SEQ ID NO: 3978 - RNA, 1701 nt, Artificial Sequence; identical to SEQ ID NO: 3543
  derived and/or modified CDS sequence (AUadapt) from InfluenzaA__ACZ17160__HA

SEQ ID NO: 3979 - RNA, 1701 nt, Artificial Sequence; identical to SEQ ID NO: 3543
  derived and/or modified CDS sequence (AUadapt) from InfluenzaA__ACZ17170__HA

SEQ ID NO: 3980 - RNA, 1701 nt, Artificial Sequence
  derived and/or modified CDS sequence (AUadapt) from InfluenzaA__ACZ17190__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcuccacgaccugccagaccccggagggcgccaucaacaccagccugcccuuccagaacauccaccccaucaccaucgggaagugccccaaguacgugaaguccaccaagcugcggcucgcgaccggccugcgcaacgucccgucgauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacucggucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 3981 - RNA, 1701 nt, Artificial Sequence; identical to SEQ ID NO: 3980
  derived and/or modified CDS sequence (AUadapt) from InfluenzaA__ACZ17200__HA

SEQ ID NO: 3982 - RNA, 1701 nt, Artificial Sequence; identical to SEQ ID NO: 116
  derived and/or modified CDS sequence (AUadapt) from InfluenzaA__ACZ17220__HA

SEQ ID NO: 3983 - RNA, 1701 nt, Artificial Sequence
  derived and/or modified CDS sequence (AUadapt) from InfluenzaA__ACZ17230__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcucaaggagcagcugucguccgugagcuccuucgagcgguucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgcuacucgaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggcgaucuacuccaccgucgccucgagccuggugcucguggucucccugggggccaucucguucuggaugugcuccaacggcagccugcagugccgcaucugcaucuga

SEQ ID NO: 3984 - RNA, 1701 nt, Artificial Sequence; identical to SEQ ID NO: 116
  derived and/or modified CDS sequence (AUadapt) from InfluenzaA__ACZ17240__HA

SEQ ID NO: 3985 - RNA, 1701 nt, Artificial Sequence; identical to SEQ ID NO: 116
  derived and/or modified CDS sequence (AUadapt) from InfluenzaA__ACZ17250__HA

SEQ ID NO: 3986 - RNA, 1701 nt, Artificial Sequence; identical to SEQ ID NO: 116
  derived and/or modified CDS sequence (AUadapt) from InfluenzaA__ACZ17260__HA

SEQ ID NO: 3987 - RNA, 1701 nt, Artificial Sequence
  derived and/or modified CDS sequence (AUadapt) from InfluenzaA__ACZ17270__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggcggugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgcgagcagcugucguccgugagcuccuucgagcgguucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgcuacucgaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaagcucuacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccgggucuaccagauccuggcgaucuacuccaccguggccucgagccuggugcucgucgugucccugggggccaucucguucuggaugugcuccaacggcagccugcagugccgcaucugcaucuga

SEQ ID NO: 3988 - RNA, 1701 nt, Artificial Sequence; identical to SEQ ID NO: 96
  derived and/or modified CDS sequence (AUadapt) from InfluenzaA__ACZ17290__HA

SEQ ID NO: 3989 - RNA, 1701 nt, Artificial Sequence; identical to SEQ ID NO: 96
  derived and/or modified CDS sequence (AUadapt) from InfluenzaA__ACZ17300__HA

SEQ ID NO: 3990 - RNA, 1701 nt, Artificial Sequence; identical to SEQ ID NO: 96
  derived and/or modified CDS sequence (AUadapt) from InfluenzaA__ACZ17310__HA

SEQ ID NO: 3991 - RNA, 1701 nt, Artificial Sequence; identical to SEQ ID NO: 116
  derived and/or modified CDS sequence (AUadapt) from InfluenzaA__ACZ17398__HA

SEQ ID NO: 3992 - RNA, 1701 nt, Artificial Sequence; identical to SEQ ID NO: 116
  derived and/or modified CDS sequence (AUadapt) from InfluenzaA__ACZ17408__HA

SEQ ID NO: 3993 - RNA, 1701 nt, Artificial Sequence; identical to SEQ ID NO: 116
  derived and/or modified CDS sequence (AUadapt) from InfluenzaA__ACZ17418__HA

SEQ ID NO: 3994 - RNA, 1701 nt, Artificial Sequence
  derived and/or modified CDS sequence (AUadapt) from InfluenzaA__ACZ17438__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagagccuguaccagaacgccgacuccuacguguucgugggcucgucccgguacagcaagaaguucaagcccgagaucgccauccgcccgaagguccgggaccaggagggccgcaugaacuacuacuggacgcugguggagcccggggacaagaucaccuucgaggccaccggcaaccucguggucccccgguacgcguucgccauggagcgcaacgccggguccggcaucaucaucucggacacccccgugcacgacugcaacacgaccugccagaccccgaagggcgccaucaacaccucccugcccuuccagaacauccaccccaucacgaucgggaagugccccaaguacgucaagagcaccaagcugcggcucgccaccggccugcgcaacgugccguccauccagucgcgggggcuguucggcgcgaucgccggguucaucgagggcggcuggaccgggaugguggacggcugguacggguaccaccaccagaacgagcagggcuccggguacgccgccgaccucaagagcacgcagaacgccaucgacgagaucaccaacaaggugaacuccgucaucgagaagaugaacacccaguucaccgcggugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgacccgcaucuaccagauccuggccaucuacagcaccgucgcguccucgcuggugcucguggucucccugggggccaucagcuucuggaugugcuccaacggcagccugcagugccggaucugcaucuga

SEQ ID NO: 3995 - RNA, 1701 nt, Artificial Sequence; identical to SEQ ID NO: 62
  derived and/or modified CDS sequence (AUadapt) from InfluenzaA__ACZ17448__HA

SEQ ID NO: 3996 - RNA, 1701 nt, Artificial Sequence; identical to SEQ ID NO: 116
  derived and/or modified CDS sequence (AUadapt) from InfluenzaA__ACZ17458__HA

SEQ ID NO: 3997 - RNA, 1701 nt, Artificial Sequence; identical to SEQ ID NO: 62
  derived and/or modified CDS sequence (AUadapt) from InfluenzaA__ACZ17478__HA

SEQ ID NO: 3998 - RNA, 1701 nt, Artificial Sequence; identical to SEQ ID NO: 116
  derived and/or modified CDS sequence (AUadapt) from InfluenzaA__ACZ17488__HA

SEQ ID NO: 3999 - RNA, 1701 nt, Artificial Sequence
  derived and/or modified CDS sequence (AUadapt) from InfluenzaA__ACZ18240__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccaccagcuccuggucguacaucguggagacguccagcuccgacaacgggaccugcuaccccggcgacuucaucgacuacgaggagcuccgggagcagcugucguccgugagcuccuucgagcgcuucgagaucuuccccaagaccucguccuggcccaaccacgacccgaacaagggcgucaccgccgccugcccccacgccggcgccaagagcuucuacaagaaccugaucuggcucgugaagaaggggaacuccuaccccaagcugucgaaguccuacaucaacgacaagggcaaggaggugcugguccucugggggauccaccaccccagcacgucggcggaccagcagucccuguaccagaacgccgacgccuacguguucgugggcaccucgcgguacuccaagaaguucaagccggagaucgccauccgccccaagguccgggaccaggagggccgcaugaacuacuacuggacccugguggagcccggggacaagaucaccuucgaggccacgggcaaccucguggucccccgguacgcguucgccauggagcgcaacgccgggagcggcaucaucaucuccgacaccccggugcacgacugcaacacgaccugccagacccccaagggcgccaucaacaccucgcugcccuuccagaacauccaccccaucaccaucgggaagugcccgaaguacgugaaguccaccaagcugcggcucgccacgggccugcgcaacguccccagcauccagucccgggggcuguucggcgcgaucgccggguucaucgagggcggcuggaccgggaugguggacggcugguacggguaccaccaccagaacgagcagggcucgggguacgccgccgaccucaaguccacccagaacgccaucgacgagaucaccaacaaggugaacagcgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggccaucuacucgaccgucgcguccagccuggugcucguggucucgcugggggccaucuccuucuggaugugcagcaacggcucccugcagugccggaucugcaucuga

SEQ ID NO: 4000 - RNA, 1701 nt, Artificial Sequence; identical to SEQ ID NO: 116
  derived and/or modified CDS sequence (AUadapt) from InfluenzaA__ACZ18241__HA

SEQ ID NO: 4001 - RNA, 1701 nt, Artificial Sequence
  derived and/or modified CDS sequence (AUadapt) from InfluenzaA__ACZ27800__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaaggaguucaagcccgagaucgccauccgcccgaagguccggggccaggaggggcgcaugaacuacuacuggacgcugguggagcccggcgacaagaucaccuucgaggcgaccgggaaccucguggucccccgguacgccuucgccauggagcgcaacgccggcucgggcaucaucaucuccgacacccccgugcacgacugcaacacgaccugccagaccccgaagggggccaucaacaccagccugcccuuccagaacauccaccccaucacgaucggcaagugccccaaguacgugaaguccaccaagcugcggcucgcgaccgggcugcgcaacgucccgucgauccagucccggggccuguucggggccaucgccggcuucaucgagggcggguggaccggcaugguggacgggugguacggcuaccaccaccagaacgagcaggggagcggcuacgccgccgaccucaaguccacgcagaacgcgaucgacgagaucaccaacaaggugaacucggucaucgagaagaugaacacccaguucaccgccgugggcaaggaguucaaccaccuggagaagcgcaucgagaaccugaacaagaaggucgacgacggguuccucgacaucuggacguacaacgccgagcugcuggugcuccuggagaacgagcggacccuggacuaccacgacuccaacgugaagaaccucuacgagaagguccgcagccagcugaagaacaacgccaaggagaucggcaacgggugcuucgaguucuaccacaagugcgacaacacgugcauggaguccgugaagaacggcaccuacgacuaccccaaguacucggaggaggccaagcugaaccgggaggagaucgacggggugaagcucgaguccacccgcaucuaccagauccuggcgaucuacagcaccgucgccucgucccuggugcucguggucagccugggcgccaucuccuucuggaugugcagcaacggcucccugcagugccggaucugcaucuga

SEQ ID NO: 4002 - RNA, 1701 nt, Artificial Sequence; identical to SEQ ID NO: 116
  derived and/or modified CDS sequence (AUadapt) from InfluenzaA__ACZ27810__HA

SEQ ID NO: 4003 - RNA, 1701 nt, Artificial Sequence; identical to SEQ ID NO: 116
  derived and/or modified CDS sequence (AUadapt) from InfluenzaA__ACZ27820__HA

SEQ ID NO: 4004 - RNA, 1701 nt, Artificial Sequence; identical to SEQ ID NO: 116
  derived and/or modified CDS sequence (AUadapt) from InfluenzaA__ACZ27830__HA

SEQ ID NO: 4005 - RNA, 1701 nt, Artificial Sequence; identical to SEQ ID NO: 3267
  derived and/or modified CDS sequence (AUadapt) from InfluenzaA__ACZ27840__HA

SEQ ID NO: 4006 - RNA, 1701 nt, Artificial Sequence; identical to SEQ ID NO: 62
  derived and/or modified CDS sequence (AUadapt) from InfluenzaA__ACZ45006__HA

SEQ ID NO: 4007 - RNA, 1701 nt, Artificial Sequence
  derived and/or modified CDS sequence (AUadapt) from InfluenzaA__ACZ45007__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggggacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 4008 - RNA, 1701 nt, Artificial Sequence; identical to SEQ ID NO: 3267
  derived and/or modified CDS sequence (AUadapt) from InfluenzaA__ACZ45008__HA

SEQ ID NO: 4009 - RNA, 1701 nt, Artificial Sequence; identical to SEQ ID NO: 3267
  derived and/or modified CDS sequence (AUadapt) from InfluenzaA__ACZ45009__HA

SEQ ID NO: 4010 - RNA, 1701 nt, Artificial Sequence; identical to SEQ ID NO: 3156
  derived and/or modified CDS sequence (AUadapt) from InfluenzaA__ACZ45010__HA

SEQ ID NO: 4011 - RNA, 1701 nt, Artificial Sequence; identical to SEQ ID NO: 116
  derived and/or modified CDS sequence (AUadapt) from InfluenzaA__ACZ45012__HA

SEQ ID NO: 4012 - RNA, 1701 nt, Artificial Sequence
  derived and/or modified CDS sequence (AUadapt) from InfluenzaA__ACZ45013__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucguccaagggggucaccgccgccugcccgcacgccggcgccaagagcuucuacaagaaccugaucuggcucgugaagaaggggaacuccuaccccaagcugucgaagagcuacaucaacgacaagggcaaggaggugcugguccucugggggauccaccaccccuccaccucggccgaccagcagucccuguaccagaacgccgacgccuacguguucgugggcacgagccgguacuccaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccgggucgggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgcgaccggccugcgcaacgucccgucgauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacucggucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 4013 - RNA, 1701 nt, Artificial Sequence; identical to SEQ ID NO: 116
  derived and/or modified CDS sequence (AUadapt) from InfluenzaA__ACZ45014__HA

SEQ ID NO: 4014 - RNA, 1701 nt, Artificial Sequence; identical to SEQ ID NO: 116
  derived and/or modified CDS sequence (AUadapt) from InfluenzaA__ACZ45016__HA

SEQ ID NO: 4015 - RNA, 1701 nt, Artificial Sequence
  derived and/or modified CDS sequence (AUadapt) from InfluenzaA__ACZ45028__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacaucccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgagccugguccucguggugucccugggggccaucucguucuggaugugcuccaacggcagccugcagugccggaucugcaucuga

SEQ ID NO: 4016 - RNA, 1701 nt, Artificial Sequence
  derived and/or modified CDS sequence (AUadapt) from InfluenzaA__ACZ45029__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccggcaacggcacgugcuaccccggggacuucaucgacuacgaggagcuccgggagcagcugucguccgugagcuccuucgagcgcuucgagaucuuccccaagaccucguccuggcccaaccacgacagcaacaagggcgucaccgccgccugcccgcacgccggggcgaaguccuucuacaagaaccugaucuggcucgugaagaagggcaacucguaccccaagcuguccaagagcuacaucaacgacaaggggaaggaggugcugguccucuggggcauccaccaccccucgaccuccgccgaccagcagagccuguaccagaacgccgacgccuacguguucgugggcacgucccgguacucgaagaaguucaagcccgagaucgccauccgcccgaagguccgggaccaggaggggcgcaugaacuacuacuggacccugguggagcccggcgacaagaucaccuucgaggcgaccgggaaccucguggucccccgguacgccuucgccauggagcgcaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagucgaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcucgagagcacccgcaucuaccagauccuggcgaucuacuccaccgucgccucgagccuggugcucguggucucccugggcgccaucucguucuggaugugcuccaacggcagccugcagugccggaucugcaucuga

SEQ ID NO: 4017 - RNA, 1701 nt, Artificial Sequence
  derived and/or modified CDS sequence (AUadapt) from InfluenzaA__ACZ45030__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacguccaccuacucgaagaaguucaagcccgagaucgccauccggccgaagguccgcgaccaggagggccggaugaacuacuacuggacccugguggagcccggggacaagaucaccuucgaggcgacgggcaaccucguggucccccgcuacgccuucaccauggagcggaacgccggguccggcaucaucaucagcgacacccccgugcacgacugcaacaccacgugccagaccccgaagggcgccaucaacaccucccugcccuuccagaacauccaccccaucaccaucgggaagugccccaaguacgucaagucgacgaagcugcgccucgccaccggccugcggaacaucccguccauccagagccgcgggcuguucggcgcgaucgccggguucaucgagggcggcuggaccgggaugguggacggcugguacggguaccaccaccagaacgagcagggcuccggguacgccgccgaccucaagucgacccagaacgccaucgacgagaucacgaacaaggugaacuccgugaucgagaagaugaacacccaguucaccgcggucggcaaggaguucaaccaccuggagaagcggaucgagaaccugaacaagaagguggacgacggcuuccucgacaucuggaccuacaacgccgagcugcugguccuccuggagaacgagcgcacgcuggacuaccacgacagcaacgugaagaaccucuacgagaaggugcggucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgcgaggagaucgacggcgugaagcucgagagcacccggaucuaccagauccuggccaucuacuccaccguggcgucgagccugguccucguggugucccugggggccaucucguucuggaugugcuccaacggcagccugcagugccgcaucugcaucuga

SEQ ID NO: 4018 - RNA, 1701 nt, Artificial Sequence
  derived and/or modified CDS sequence (AUadapt) from InfluenzaA__ACZ45031__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucacgauggagcgcaacgugggguccggcaucaucaucucggacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagucgcgggggcuguucggcgccaucgcgggguucaucgagggcggcuggaccgggaugguggacggcugguacggguaccaccaccagaacgagcagggcuccggguacgccgccgaccucaagagcacccagaacgccaucgacgagaucaccaacaaggucaacuccgugaucgagaagaugaacacgcaguucaccgccgucggcaaggaguucaaccaccuggagaagcgcaucgagaaccugaacaagaagguggacgacggcuuccucgacaucuggaccuacaacgcggagcugcuggugcuccuggagaacgagcggacccuggacuaccacgacucgaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagucgacccgcaucuaccagauccuggccaucuacuccaccguggccagcucgcuggugcucgucgugucccugggggcgaucagcuucuggaugugcuccaacggcagccugcagugccggaucugcaucuga

SEQ ID NO: 4019 - RNA, 1701 nt, Artificial Sequence
  derived and/or modified CDS sequence (AUadapt) from InfluenzaA__ACZ45034__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacgugcaccccaucaccaucgggaagugccccaaguacgucaagagcaccaagcugcggcucgcgaccggccugcgcaacgugccgcccauccagucccgggggcuguucggcgccaucgccggguucaucgagggcggcuggacggggaugguggacggcugguacggguaccaccaccagaacgagcagggcucgggguacgccgccgaccucaaguccacccagaacgcgaucgacgagaucaccaacaaggucaacagcgugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacuccaacgucaagaaccucuacgagaaggugcgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgucaagcucgaguccacccgcaucuaccagauccuggcgaucuacucgaccguggccuccagccuggugcucgucgugucgcugggggccaucuccuucuggaugugcagcaacggcucccugcagugccggaucugcaucuga

SEQ ID NO: 4020 - RNA, 1701 nt, Artificial Sequence; identical to SEQ ID NO: 116
  derived and/or modified CDS sequence (AUadapt) from InfluenzaA__ACZ45036__HA

SEQ ID NO: 4021 - RNA, 1701 nt, Artificial Sequence; identical to SEQ ID NO: 116
  derived and/or modified CDS sequence (AUadapt) from InfluenzaA__ACZ45037__HA

SEQ ID NO: 4022 - RNA, 1701 nt, Artificial Sequence; identical to SEQ ID NO: 4015
  derived and/or modified CDS sequence (AUadapt) from InfluenzaA__ACZ45038__HA

SEQ ID NO: 4023 - RNA, 1701 nt, Artificial Sequence; identical to SEQ ID NO: 3267
  derived and/or modified CDS sequence (AUadapt) from InfluenzaA__ACZ45039__HA

SEQ ID NO: 4024 - RNA, 1701 nt, Artificial Sequence; identical to SEQ ID NO: 116
  derived and/or modified CDS sequence (AUadapt) from InfluenzaA__ACZ45040__HA

SEQ ID NO: 4025 - RNA, 1701 nt, Artificial Sequence; identical to SEQ ID NO: 116
  derived and/or modified CDS sequence (AUadapt) from InfluenzaA__ACZ52567__HA

SEQ ID NO: 4026 - RNA, 1701 nt, Artificial Sequence; identical to SEQ ID NO: 116
  derived and/or modified CDS sequence (AUadapt) from InfluenzaA__ACZ52568__HA

SEQ ID NO: 4027 - RNA, 1701 nt, Artificial Sequence; identical to SEQ ID NO: 3483
  derived and/or modified CDS sequence (AUadapt) from InfluenzaA__ACZ52569__HA

SEQ ID NO: 4028 - RNA, 1701 nt, Artificial Sequence
  derived and/or modified CDS sequence (AUadapt) from InfluenzaA__ACZ53956__HA
augaagaccaucaucgcccugucguacaucuucugccucgcccuggcgcagaagcugcccggcaacgacaacuccaccgccacgcucugccuggggcaccacgccgugccgaacggcacccuggucaagaccaucaccaacgaccagaucgaggugacgaacgccaccgagcucgugcagucguccagcaccgggcgcaucugcgacucgccccaccagauccuggacggcgagaacugcacccugaucgacgcccuccugggggacccccacugcgacggcuuccagaacaaggagugggaccuguucgucgagcggagcaaggcguacuccaacugcuaccccuacgacgugccggacuacgccucgcuccgcucccugguggccagcuccggcacgcuggaguucaacaacgagucguucaacuggaccggggucgcccagaacggcaccuccucggcgugcaagcggcgcuccaucaagagcuucuucuccacccucaacuggcugcaccagcugcagaaccgguaccccgcccucaacgugacgaugcccaacaacgacaaguucgacaagcuguacaucuggggcgugcaccaccccucgaccgacuccgaccagaucagcgucuacgcccaggccucggggcgcgugaccguguccaccaagcggagccagcagacggucaucccgaacaucgggucccgccccugggugcggggcgugucgucccgcaucucgaucuacuggaccaucgucaagcccggcgacauccugcucaucaacuccaccgggaaccugaucgcgccccggggcuacuucaagauccgcagcgggaaguccucgaucaugcgguccgacgccccgaucggcaagugcaacagcgagugcaucacccccaacggcuccauccccaacgacaagcccuuccagaacgugaaccgcaucacguacggggccugcccgcgguacgugaagcagaacacccugaagcucgccaccggcaugcgcaacguccccgagaagcagacccgggggaucuucggcgccaucgccggguucaucgagaacggcugggagggcaugauggacgggugguacggcuuccgccaccagaacucggaggggacgggccaggcggccgaccugaaguccacccaggccgccaucaaccagaucaacgggaagcugaaccggcucaucgagaagaccaacgagaaguuccaccagaucgagaaggaguucagcgagguggagggccgcauccaggaccuggagaaguacguggaggacaccaagaucgaccugugguccuacaacgccgagcuccuggucgcgcuggagaaccagcacacgaucgaccucaccgacucggagaugaacaagcuguucgagcggacccgcaagcagcugcgcgagaacgccgaggacaugggcaacgggugcuucaagaucuaccacaagugcgacaacgccugcaucggcuccauccggaacgggaccuacgaccacgacguguaccgcgacgaggcccucaacaaccgguuccagaucaagggcguggagcugaaguccggguacaaggacuggauccuguggaucagcuucgccaucuccugcuuccuccugugcgucgugcugcucggcuucaucaugugggcgugccagcgcggcaacauccggugcaacaucugcaucuga

SEQ ID NO: 4029 - RNA, 1701 nt, Artificial Sequence
  derived and/or modified CDS sequence (AUadapt) from InfluenzaA__ACZ53967__HA
augaagaccaucaucgcccugucguacaucuucugccucgcccuggcgcagaagcugcccggcaacgacaacuccaccgccacgcucugccuggggcaccacgccgugccgaacggcacccuggucaagaccaucaccaacgaccagaucgaggugacgaacgccaccgagcucgugcagucguccagcaccgggcgcaucugcgacucgccccaccagauccuggacggcgagaacugcacccugaucgacgcccuccugggggacccccacugcgacggcuuccagaacaaggagugggaccuguucgucgagcggucgaaggcguacuccaacugcuaccccuacgacgugccggacuacgccagccuccgcucccugguggccucguccggcacgcuggaguucaacaacgagucguucaacuggaccggggucgcccagaacggcaccuccagcgcgugcaagcggcgcuccaucaagucguucuucuccacccucaacuggcugcaccagcugcagaaccgguaccccgcccucaacgugacgaugcccaacaacgacaaguucgacaagcuguacaucuggggcgugcaccaccccucgaccgacuccgaccagaccagccuguacgcccaggccucggggcgcgucaccguguccacgaagcggucgcagcagaccgugaucccgaacaucgggucccgccccuggguccggggcgugagcucccgcaucucgaucuacuggaccaucgugaagcccggcgacguccucgugaucaacuccaacgggaaccugaucgcgccccggggcuacuucaagaugcgcucggggaaguccagcaucaugcgguccgacgccccgaucggcaagugcaacucggagugcaucacccccaacggcuccauccccaacgacaagcccuuccagaacgugaaccgcaucacguacggggccugcccgcgguacgucaagcagaacacccugaagcucgccaccggcaugcgcaacgugcccgagaagcagacccgggggaucuucggcgccaucgccggguucaucgagaacggcugggagggcaugauggacgggugguacggcuuccgccaccagaacucggaggggacgggccaggcggccgaccugaaguccacccaggccgccaucaaccagaucaacgggaagcugaacaagcucaucgagaagaccaacgagaaguuccaccagaucgagaaggaguucagcgagguggagggccggauccaggaccuggagaaguacgucgaggacaccaagaucgaccugugguccuacaacgccgagcuccugguggcgcuggagaaccagcacacgaucgaccucaccgacucggagaugaacaagcuguucgagcgcacccggaagcagcugcgcgagaacgccgaggacaugggcaacgggugcuucaagaucuaccacaagugcgacaacgccugcaucggcuccauccgcaacgggaccuacgaccacgacguguaccgggacgaggcccucaacaaccgcuuccagaucaagggcgucgagcugaaguccggguacaaggacuggauccuguggaucucguucgccaucuccugcuuccuccugugcgugguccugcucggcagcaucaugugggcgugccagcggggcaacauccgcugcaacaucugcaucuga

SEQ ID NO: 4030 - RNA, 1701 nt, Artificial Sequence
  derived and/or modified CDS sequence (AUadapt) from InfluenzaA__ACZ53978__HA
augaagaccaucaucgcccugucguacaucuucugccucgcccuggcgcagaagcugcccggcaacgacaacuccaccgccacgcucugccuggggcaccacgccgugccgaacggcacccuggucaagaccaucaccaacgaccagaucgaggugacgaacgccaccgagcucgugcagucguccagcaccgggcgcaucugcgacucgccccaccagauccuggacggcgagaacugcacccugaucgacgcccuccugggggacccccacugcgacggcuuccagaacaaggagugggaccuguucgucgagcggagcaaggcguacuccaacugcuaccccuacgacgugccggacuacgccucgcucaagucccugaucgccagcuccggcacgcuggaguucaacaacgagucguucaacuggaucggggugucccagaacggcaccagcuccgccugcaagcgcaucucgaucaccgucuccuucaacaagcucaacuggcugcaccagcugaaguaccgguaccccgcgcucaacgugaccaugcccaacaacgacaaguucgacaagcuguacaucuggggcgugcaccaccccagcacggacuccgaccagaccucgcuguacgcccaggccagcgggcgcgucaccguguccaccaagcggucgcagcagacggugaucccgaacaucgggucccgccccuggguccggggcgugagcucccgcaucucgaucuacuggaccaucgugaagcccggcgacguccucgugaucaacuccaacgggaaccugaucgcgccccggggcuacuucaagaugcgcagcgggaaguccucgaucaugcgguccgacgccccgaucggcaagugcaacagcgagugcaucacccccaacggcuccauccccaacgacaagcccuuccagaacgugaaccgcaucaccuacggggccugcccgcgguacgucaagcagaacacgcugaagcucgccaccggcaugcgcaacgugcccgagaagcagacccgggggaucuucggcgccaucgccggguucaucgagaacggcugggagggcaugguggacgggugguacggcuuccgccaccagaacucggaggggaccggccaggccgcggaccugaaguccacgcaggccgccaucaaccagaucaccgggaagcugaacaagcucaucgagaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacucggagaugaacaagcuguucgagcgcacccggaagcagcugcgcgagaacgcggaggacaugggcaacgggugcuucaagaucuaccacaagugcgacaacgccugcaucggcuccauccggaacgggaccuacgaccacgacgucuaccgcgacgaggcccucaacaaccgcuuccagaucaagggcguggagcugaaguccggguacaaggacuggauccuguggaucagcuucgccaucuccugcuuccuccugugcgucgugcugcucggcuucaucaugugggccugccagcggggcaacauccgcugcaacaucugcaucuga

SEQ ID NO: 4031 - RNA, 1701 nt, Artificial Sequence
  derived and/or modified CDS sequence (AUadapt) from InfluenzaA__ACZ56080__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcucccacgccggcgccaagagcuucuacaagaaccugaucuggcucgugaagaaggggaacuccuacccgaagcugucgaagagcuacaucaacgacaagggcaaggaggugcugguccucugggggauccaccaccccuccaccucggccgaccagcagucccuguaccagaacgccgacgccuacguguucgugggcacgagccgguacuccaagaaguucaagcccgagaucgccauccgccccaagguccggggccaggaggggcgcaugaacuacuacuggacccugguggagccgggcgacaagaucaccuucgaggcgaccgggaaccucguggucccccgguacgccuucgccauggagcgcaacgccggcucgggcaucaucaucuccgacacgcccgugcacgacugcaacacgaccugccagacccccaagggggccaucaacaccagccugccguuccagaacauccaccccaucaccaucggcaagugccccaaguacgugaaguccaccaagcugcggcucgcgaccgggcugcgcaacguccccucgauccagucccggggccuguucggggccaucgccggcuucaucgagggcggguggacgggcaugguggacgggugguacggcuaccaccaccagaacgagcaggggagcggcuacgccgccgaccucaaguccacccagaacgcgaucgacgagaucaccaacaaggugaacucggucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacuccaacgugaagaaccucuacgagaagguccgcagccagcugaagaacaacgccaaggagaucggcaacgggugcuucgaguucuaccacaagugcgacaacacgugcauggaguccgugaagaacggcaccuacgacuacccgaaguacucggaggaggccaagcugaaccgggaggagaucgacggggugaagcucgaguccacccgcaucuaccagauccuggcgaucuacagcaccgucgccucgucccuggugcucguggucagccugggcgccaucuccuucuggaugugcagcaacggcucccugcagugccggaucugcaucuga

SEQ ID NO: 4032 - RNA, 1701 nt, Artificial Sequence
  derived and/or modified CDS sequence (AUadapt) from InfluenzaA__ACZ61118__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccagagcaccuccgccgaccagcagucgcuguaccagaacgccgacgccuacguguucgugggcuccagccgguacuccaagaaguucaagcccgagaucgccauccgccccaagguccgggaccaggagggccgcaugaacuacuacuggacgcugguggagccgggggacaagaucaccuucgaggcgaccggcaaccucguggucccccgguacgccuucgccauggagcgcaacgccgggucgggcaucaucaucuccgacacccccgugcacgacugcaacacgaccugccagacccccaagggcgccaucaacaccagccugccguuccagaacauccaccccaucacgaucgggaagugccccaaguacgugaaguccaccaagcugcggcucgcgaccggccugcgcaacguccccucgauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuacccgaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 4033 - RNA, 1701 nt, Artificial Sequence
  derived and/or modified CDS sequence (AUadapt) from InfluenzaA__ACZ61119__HA
auggaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccacaacauccaccccaucacgaucgggaagugccccaaguacgugaaguccaccaagcugcggcucgcgaccggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcgcaucgagaaccugaacaagaaggucgacgacggcuuccucgacaucuggacguacaacgccgagcugcugauccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuaccccaaguacucggaggaggccaagcugaaccgggaggagaucgacggcgugaagcucgaguccacccgcaucuaccagauccuggcgaucuacagcaccguggccucgucccugguccucguggugagccugggggccaucuccuucuggaugugcagcaacggcucccugcagugccggaucugcaucuga

SEQ ID NO: 4034 - RNA, 1701 nt, Artificial Sequence; identical to SEQ ID NO: 116
  derived and/or modified CDS sequence (AUadapt) from InfluenzaA__ACZ61122__HA

SEQ ID NO: 4035 - RNA, 1701 nt, Artificial Sequence; identical to SEQ ID NO: 116
  derived and/or modified CDS sequence (AUadapt) from InfluenzaA__ACZ61123__HA

SEQ ID NO: 4036 - RNA, 1701 nt, Artificial Sequence; identical to SEQ ID NO: 3712
  derived and/or modified CDS sequence (AUadapt) from InfluenzaA__ACZ74627__HA

SEQ ID NO: 4037 - RNA, 1698 nt, Artificial Sequence
  derived and/or modified CDS sequence (AUadapt) from InfluenzaA__ACZ81554__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacaaccacaacgggaagcucugccugcugaagggcaucgcgccccuccagcuggggaacugcaccgucgccggcuggauccuggggaacccggagugcgagcuccugaucagcaaggaguccuggucguacaucguggagaagcccaaccccgagaacggcacgugcuaccccggccacuucgccgacuacgaggagcugcgcgagcagcucuccagcguguccagcuucgagcgguucgagaucuucccgaaggaguccucguggcccaaccacaccgucaccgggguguccgccagcugcucccacaacggcgagaacagcuucuaccgcaaccugcuguggcucaccgggaagaacggccuguaccccaaccuguccaagucguacgccaacaacaaggagaaggaggugcucguccuguggggcgugcaccacccgcccaacaucgccgaccagaagacgcuguaccacaccgagaacgccuacguguccgucgugagcucccacuacucgcggaaguucacccccgagaucgccaagcgccccaagauccgggaccaggaggggcgcaucaacuacuacuggacccuccuggagcccggcgacacgaucaucuucgaggcgaacgggaaccugaucgccccgcgguacgccuucgcccucagccgcggcuucggguccggcaucaucaacagcaacgcccccauggacaagugcgacgcgaagugccagacgccccagggcgccaucaacuccucgcugcccuuccagaacgugcacccggucaccaucggggagugccccaaguacgugcgguccgccaagcugcgcauggugaccggccuccggaacauccccagcauccagucccgcgggcuguucggcgccaucgccggguucaucgagggcggcuggaccgggauggucgacggcugguacggguaccaccaccagaacgagcagggcagcggguacgcggccgaccagaaguccacccagaacgccaucaacggcaucaccaacaaggugaacucggugaucgagaagaugaacacccaguucacggccgucggcaaggaguucaacaagcuggagcggcgcauggagaaccucaacaagaagguggacgacggguucaucgacaucuggaccuacaacgccgagcugcugguccuccuggagaacgagcggacccuggacuuccacgacuccaacgugaagaaccucuacgagaaggucaagagccagcugaagaacaacgcgaaggagaucggcaacgggugcuucgaguucuaccacaagugcaacgacgagugcauggaguccgugaagaacggcaccuacgacuaccccaaguacucggaggaguccaagcugaaccgcgagaagaucgacggggugaagcucgagagcaugggcguguaccagauccuggccaucuacuccacggucgccagcucccuggugcuccuggugucgcugggcgccaucagcuucuggaugugcuccaacgggagccuccagugccggaucugcaucuga

SEQ ID NO: 4038 - RNA, 1698 nt, Artificial Sequence
  derived and/or modified CDS sequence (AUadapt) from InfluenzaA__ACZ81555__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccucguggcccaaccacacggucaccgggguguccgccagcugcucccacaacggcgagaacagcuucuaccgcaaccugcuguggcucaccgggaagaacggccuguaccccaaccuguccaagucguacgccaacaacaaggagaaggaggugcucguccuguggggcgugcaccacccgcccaacaucggcgaccagaagacccuguaccacacggagaacgccuacguguccgucgugagcagccacuacucccggaaguucacccccgagaucgccaagcgccccaaggugcgggaccaggagggccgcaucaacuacuacugggcccuccuggagcccggggacaccaucaucuucgaggcgaacggcaaccugaucgccccgcgguacgccuucgcccucucgcgcggguucggcuccggcaucaucaacagcaacgcccccauggacaagugcgacgcgaagugccagacgccccagggggccaucaacuccagccugcccuuccagaacguccacccggugaccaucggcgagugccccaaguacgugcgguccgccaagcugcgcauggucaccgggcuccggaacauccccucgauccagucccgcggccuguucggggccaucgccggcuucaucgagggcggguggaccggcaugguggacgggugguacggcuaccaccaccagaacgagcaggggagcggcuacgcggccgaccagaaguccacccagaacgccaucaacggcaucacgaacaaggugaacagcgucaucgagaagaugaacacccaguucaccgccguggggaaggaguucaacaagcuggagcggcgcauggagaaccucaacaagaaggucgacgacggcuucaucgacaucuggaccuacaacgccgagcugcuggugcuccuggagaacgagcggacgcuggacuuccacgacuccaacgugaagaaccucuacgagaaggucaagucgcagcugaagaacaacgcgaaggagaucgggaacggcugcuucgaguucuaccacaagugcaacgacgagugcauggaguccgugaagaacgggaccuacgacuaccccaaguacagcgaggaguccaagcugaaccgcgagaagaucgacggcgugaagcucgagagcaugggcgucuaccagauccuggccaucuacuccaccguggccucgagccuggugcuccuggucucccugggggccaucagcuucuggaugugcuccaacggcagccuccagugccggaucugcaucuga

SEQ ID NO: 4039 - RNA, 1698 nt, Artificial Sequence
  derived and/or modified CDS sequence (AUadapt) from InfluenzaA__ACZ81556__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucucgaaggaguccuggagcuacaucguggagaagcccaaccccgagaacgggaccugcuaccccggccacuucgccgacuacgaggagcugcgcgagcagcucuccagcguguccucguucgagcgguucgagaucuucccgaaggaguccagcuggcccaaccacacggucaccggggccuccgccagcugcucccacaacggcgagaacucguucuaccgcaaccugcuguggcucaccgggaagaacggccuguaccccaaccuguccaagagcuacgccaacaacaaggagaaggaggugcucgugcuguggggcguccaccacccgcccaacaucgccgaccagaagacccuguaccacacggagaacgccuacguguccguggucagcucgcacuacucccggaaguucacccccgagaucgcgaagcgccccaaggugcgggaccaggagggccgcaucaacuacuacuggacccuccuggagcccggcgacaccaucaucuucgaggccaacgggaaccugaucgccccgcgguacgccuucgcccucagccgcggcuucggguccggcaucaucaacucgaacgcgcccauggacaagugcgacgccaagugccagacgccccagggcgccaucaacuccagccugcccuuccagaacgugcacccggucaccaucggggagugccccaaguacgugcgguccgccaagcugcgcauggugaccggccuccggaacauccccagcauccagucccgcgggcuguucggcgccaucgcgggguucaucgagggcggcuggaccgggauggucgacggcugguacggguaccaccaccagaacgagcagggcucgggguacgccgccgaccagaaguccacgcagaacgccaucaacggcaucaccaacaaggugaacagcgugaucgagaagaugaacacccaguucaccgccgucggcaaggaguucaacaagcuggagcggcgcauggagaaccucaacaagaagguggacgacggguucaucgacaucuggacguacaacgcggagcugcugguccuccuggagaacgagcggacccuggacuuccacgacuccaacgugaagaaccucuacgagaaggucaagagccagcugaagaacaacgccaaggagaucggcaacgggugcuucgaguucuaccacaagugcaacgacgagugcauggaguccgugaagaacggcaccuacgacuaccccaaguacucggaggaguccaagcugaacaaggagaagaucgacggggugaagcucgagagcaugggcguguaccagauccuggccaucuacuccaccgucgccagcucgcuggugcuccuggugucccugggcgccaucagcuucuggaugugcuccaacgggagccuccagugccgcaucugcaucuga

SEQ ID NO: 4040 - RNA, 1701 nt, Artificial Sequence
  derived and/or modified CDS sequence (AUadapt) from InfluenzaA__ACZ81557__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcggcucgccccaccagauccucgacgggaagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucgucgccagcuccgggacgcuggaguucaacaacgagucguucaacuggaccggcgugacccagaacgggaccuccucggccugcauccgccgguccaagaacagcuucuucucccgccugaacuggcucacgcaccugaacuucaaguaccaggcccugaacgugaccaugcccaacaacgagcaguucgacaagcucuacaucuggggcguccaccaccccgggaccgacaaggaccagaucuuccuguacgcgcaggccucgggccggaucaccguguccacgaagcgcagccagcagaccgugauccccaacaucggcucgcggccgcgcguccggaacauccccucccgcaucagcaucuacuggaccaucgugaagcccggggacauccugcucaucaacuccaccggcaaccugaucgcgccccggggguacuucaagauccagucgggcaaguccucgaucaugcgcuccgacgccccgaucggcaagugcaacagcgagugcaucacgcccaacggguccauccccaacgacaagcccuuccagaacgugaaccggaucaccuacggcgccugcccgcgcuacgucaagcagaacacccugaagcucgccaccgggaugcggaacgugcccgagaagcagacgcgcggcaucuucggggccaucgccggcuucaucgagaacggcugggaggggaugguggacggcugguacggguuccggcaccagaacucggagggccgcgggcaggccgccgaccugaaguccacccaggcggccaucgaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgggagaacgccgaggacaugggcaacgggugcuucaagaucuaccacaagugcgacaacgcgugcaucggcuccauccgcaacgggaccuacgaccacgacgucuaccgcgacgaggcccucaacaaccgguuccagaucaagggcguggagcugaaguccggcuacaaggacuggauccuguggaucuccuucgccaucagcugcuuccuccugugcguggcccugcucggguucaucaugugggccugccagaagggcaacauccgcugcaacaucugcaucuga

SEQ ID NO: 4041 - RNA, 1701 nt, Artificial Sequence
  derived and/or modified CDS sequence (AUadapt) from InfluenzaA__ACZ81558__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcaagaacugcacccugaucgacgcccugcucggggacccccacugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaagaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcagaccgccaucccgaacaucggcucgcggccccgcgugcggaacauccccucccgcaucagcaucuacuggaccaucgucaagcccggcgacauccugcucaucaacuccaccgggaaccugaucgccccgcggggcuacuucaagauccgcucggggaaguccagcaucaugcgguccgacgcccccaucggcaagugcaacucggagugcaucacgcccaacggcuccauccccaacgacaagccguuccagaacgugaaccgcaucaccuacggggcgugcccccgguacgugaagcagaacacccugaagcucgccaccggcaugcgcaacguccccgagaagcagacgcgggggaucuucggcgccaucgccggguucaucgagaacggcugggagggcaugguggacgggugguacggcuuccgccaccagaacucggaggggcggggccaggccgcggaccugaaguccacccaggccgccaucgaccagaucaacgggaagcugaaccgccucaucgagaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacacgaucgaccucaccgacucggagaugaacaagcuguucgagaagaccaagaagcagcugcgcgagaacgcggaggacaugggcaacgggugcuucaagaucuaccacaagugcgacaacgccugcaucggcuccauccgcaacgggaccuacgaccacgacguguaccgggacgaggcccucaacaaccgcuuccagaucaagggcgucgagcugaaguccggguacaaggacuggauccuguggaucuccuucgccaucagcugcuuccuccugugcguggcccugcucggcuucaucaugugggcgugccagaagggcaacauccggugcaacaucugcaucuga

SEQ ID NO: 4042 - RNA, 1701 nt, Artificial Sequence
  derived and/or modified CDS sequence (AUadapt) from InfluenzaA__ACZ81559__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcaagaacugcacccugaucgacgcccugcucggggacccccacugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaagaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcagaccgccaucccgaacaucggcucgcggccccgcgugcggaacauccccucccgcaucagcaucuacuggaccaucgucaagcccggcgacauccugcucaucaacuccaccgggaaccugaucgccccgcggggcuacuucaagauccgcucggggaaguccagcaucaugcgguccgacgcccccaucggcaagugcaacucggagugcaucacgcccaacggcuccauccccaacgacaagccguuccagaacgugaaccgcaucaccuacggggcgugcccccgguacgugaagcagaacacccugaagcucgccaccggcaugcgcaacguccccgagaagcagacgcgggggaucuucggcgccaucgccggguucaucgagaacggcugggagggcaugguggacgggugguacggcuuccgccaccagaacucggaggggcggggccaggccgcggaccugaaguccacccaggccgccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacacgaucgaccucaccgacucggagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacguguaccgggacgaggcccucaacaaccgcuuccagaucaagggggucgagcugaaguccggcuacaaggacuggauccuguggaucuccuucgccaucagcugcuuccuccugugcguggcccugcucggcuucaucaugugggcgugccagaaggggaacauccggugcaacaucugcaucuga

SEQ ID NO: 4043 - RNA, 1701 nt, Artificial Sequence; identical to SEQ ID NO: 116
  derived and/or modified CDS sequence (AUadapt) from InfluenzaA__ACZ81632__HA

SEQ ID NO: 4044 - RNA, 1701 nt, Artificial Sequence; identical to SEQ ID NO: 116
  derived and/or modified CDS sequence (AUadapt) from InfluenzaA__ACZ81642__HA

SEQ ID NO: 4045 - RNA, 1701 nt, Artificial Sequence
  derived and/or modified CDS sequence (AUadapt) from InfluenzaA__ACZ81652__HA
augaaggccauccuggugguccuccuguacaccuucgccaccgcgaacgccgacacgcugugcaucggcuaccacgccaacaacucgaccgacaccguggacaccgugcucgagcgcaacgucacggugacccacuccgugaaccugcuggaggacaagcacaacgggaagcucugcaagcugcggggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgcgagcagcugucguccgugagcuccuucgagcgguucgagaucuuccccaagaccucguccuggcccaaccacgacagcaacaagggggucaccgccgccugcccgcacgccgaggcgaaguccuucuacaagaaccugaucuggcucgugaagaagggcaacucguaccccaagcuguccaagagcuacaucaacgacaaggggaaggaggugcugguccucuggggcauccaccaccccucgaccuccgccgaccagcagagccuguaccagaacgccgacgccuacguguucguggggacgucccgcuacucgaagaaguucaagcccgagaucgccauccggccgaagguccgcggccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggcgaucuacuccaccgucgccucgagccuggugcucguggucucccugggggccaucucguucuggaugugcuccaacggcagccugcagugccgcaucugcaucuga

SEQ ID NO: 4046 - RNA, 1701 nt, Artificial Sequence
  derived and/or modified CDS sequence (AUadapt) from InfluenzaA__ACZ92130__HA
auggaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccacaacauccaccccaucacgaucgggaagugccccaaguacgugaaguccaccaagcugcggcucgcgaccggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcaucgaguccgugaagaacgggaccuacgacuaccccaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 4047 - RNA, 1701 nt, Artificial Sequence; identical to SEQ ID NO: 3156
  derived and/or modified CDS sequence (AUadapt) from InfluenzaA__ACZ92131__HA

SEQ ID NO: 4048 - RNA, 1701 nt, Artificial Sequence; identical to SEQ ID NO: 3156
  derived and/or modified CDS sequence (AUadapt) from InfluenzaA__ACZ92132__HA

SEQ ID NO: 4049 - RNA, 1701 nt, Artificial Sequence; identical to SEQ ID NO: 3156
  derived and/or modified CDS sequence (AUadapt) from InfluenzaA__ACZ92133__HA

SEQ ID NO: 4050 - RNA, 1701 nt, Artificial Sequence; identical to SEQ ID NO: 116
  derived and/or modified CDS sequence (AUadapt) from InfluenzaA__ACZ92134__HA

SEQ ID NO: 4051 - RNA, 1701 nt, Artificial Sequence; identical to SEQ ID NO: 116
  derived and/or modified CDS sequence (AUadapt) from InfluenzaA__ACZ95465__HA

SEQ ID NO: 4052 - RNA, 1701 nt, Artificial Sequence; identical to SEQ ID NO: 62
  derived and/or modified CDS sequence (AUadapt) from InfluenzaA__ACZ95837__HA

SEQ ID NO: 4053 - RNA, 1701 nt, Artificial Sequence; identical to SEQ ID NO: 116
  derived and/or modified CDS sequence (AUadapt) from InfluenzaA__ACZ95847__HA

SEQ ID NO: 4054 - RNA, 1701 nt, Artificial Sequence
  derived and/or modified CDS sequence (AUadapt) from InfluenzaA__ACZ95857__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccuccaagggcgccaucaacaccagccugccguuccagaacauccaccccaucaccaucgggaagugccccaaguacgugaaguccaccaagcugcggcucgcgaccggccugcgcaacguccccucgauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacucggucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuacccgaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 4055 - RNA, 1701 nt, Artificial Sequence; identical to SEQ ID NO: 116
  derived and/or modified CDS sequence (AUadapt) from InfluenzaA__ACZ95867__HA

SEQ ID NO: 4056 - RNA, 1701 nt, Artificial Sequence
  derived and/or modified CDS sequence (AUadapt) from InfluenzaA__ACZ95887__HA
auggaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccggaaccaggagggccgcaugaacuacuacuggacgcugguggagcccggggacaagaucaccuucgaggcgaccggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccacaacauccaccccaucacgaucgggaagugccccaaguacgugaaguccaccaagcugcggcucgcgaccggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 4057 - RNA, 1701 nt, Artificial Sequence; identical to SEQ ID NO: 116
  derived and/or modified CDS sequence (AUadapt) from InfluenzaA__ACZ95897__HA

SEQ ID NO: 4058 - RNA, 1701 nt, Artificial Sequence
  derived and/or modified CDS sequence (AUadapt) from InfluenzaA__ACZ95907__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccguguacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgacccgcaucuaccagauccuggcgaucuacuccaccgucgccagcucgcuggugcucguggucucccugggggccaucagcuucuggaugugcuccaacggcagccugcagugccggaucugcaucuga

SEQ ID NO: 4059 - RNA, 1701 nt, Artificial Sequence; identical to SEQ ID NO: 116
  derived and/or modified CDS sequence (AUadapt) from InfluenzaA__ACZ95927__HA

SEQ ID NO: 4060 - RNA, 1701 nt, Artificial Sequence
  derived and/or modified CDS sequence (AUadapt) from InfluenzaA__ACZ95937__HA
auggaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccaacgccgaccagcagucccuguaccagaacgccgacgccuacguguucgugggcagcucccgguacucgaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccggguccggcaucaucaucagcgacacccccgugcacgacugcaacacgaccugccagaccccgaagggcgccaucaacaccucccugcccuuccacaacauccaccccaucacgaucgggaagugccccaaguacgucaagucgaccaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagucgacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 4061 - RNA, 1701 nt, Artificial Sequence; identical to SEQ ID NO: 3156
  derived and/or modified CDS sequence (AUadapt) from InfluenzaA__ACZ95947__HA

SEQ ID NO: 4062 - RNA, 1701 nt, Artificial Sequence; identical to SEQ ID NO: 116
  derived and/or modified CDS sequence (AUadapt) from InfluenzaA__ACZ95957__HA

SEQ ID NO: 4063 - RNA, 1701 nt, Artificial Sequence; identical to SEQ ID NO: 3156
  derived and/or modified CDS sequence (AUadapt) from InfluenzaA__ACZ95967__HA

SEQ ID NO: 4064 - RNA, 1701 nt, Artificial Sequence; identical to SEQ ID NO: 4060
  derived and/or modified CDS sequence (AUadapt) from InfluenzaA__ACZ95977__HA

SEQ ID NO: 4065 - RNA, 1701 nt, Artificial Sequence
  derived and/or modified CDS sequence (AUadapt) from InfluenzaA__ACZ95987__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacaucccguccauccagagccgggggcuguucggcgccaucgccggguucaucgagggcggcuggacggggaugaucgacggcugguacggguaccaccaccagaacgagcagggcuccggguacgccgccgaccucaagucgacccagaacgcgaucgacgagaucaccaacaaggugaacuccgugaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgucaagcucgagagcacccgcaucuaccagauccuggcgaucuacuccaccguggccucgagccuggugcucgucgugucccugggggccaucucguucuggaugugcuccaacggcagccugcagugccggaucugcaucuga

SEQ ID NO: 4066 - RNA, 1701 nt, Artificial Sequence; identical to SEQ ID NO: 116
  derived and/or modified CDS sequence (AUadapt) from InfluenzaA__ACZ95997__HA

SEQ ID NO: 4067 - RNA, 1701 nt, Artificial Sequence; identical to SEQ ID NO: 116
  derived and/or modified CDS sequence (AUadapt) from InfluenzaA__ACZ96007__HA

SEQ ID NO: 4068 - RNA, 1701 nt, Artificial Sequence; identical to SEQ ID NO: 62
  derived and/or modified CDS sequence (AUadapt) from InfluenzaA__ACZ96017__HA

SEQ ID NO: 4069 - RNA, 1701 nt, Artificial Sequence; identical to SEQ ID NO: 116
  derived and/or modified CDS sequence (AUadapt) from InfluenzaA__ACZ96027__HA

SEQ ID NO: 4070 - RNA, 1701 nt, Artificial Sequence; identical to SEQ ID NO: 4060
  derived and/or modified CDS sequence (AUadapt) from InfluenzaA__ACZ96047__HA

SEQ ID NO: 4071 - RNA, 1701 nt, Artificial Sequence
  derived and/or modified CDS sequence (AUadapt) from InfluenzaA__ACZ96057__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugccugcacgccggcgcgaaguccuucuacaagaaccucaucuggcuggugaagaaggggaacagcuacccgaagcuguccaagucguacaucaacgacaagggcaaggaggugcucguccugugggggauccaccaccccagcaccuccgccgaccagcagucgcuguaccagaacgccgacgccuacguguucgugggcacgucccgguacagcaagaaguucaagcccgagaucgccauccgccccaagguccgggaccaggagggccgcaugaacuacuacuggacccucguggagccgggggacaagaucaccuucgaggcgaccggcaaccugguggucccccgguacgccuucgccauggagcgcaacgccggguccggcaucaucaucucggacacgcccgugcacgacugcaacacgaccugccagacccccaagggcgccaucaacaccucccugccguuccagaacauccaccccaucaccaucgggaagugccccaaguacgucaagagcaccaagcuccggcuggcgaccggccugcgcaacauccccuccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcgcaucgagaaccucaacaagaagguggacgacggcuuccuggacaucuggaccuacaacgccgagcugcucguccugcuggagaacgagcggacccucgacuaccacgacucgaacgugaagaaccuguacgagaaggugcgcucccagcugaagaacaacgccaaggagaucgggaacggcugcuucgaguucuaccacaagugcgacaacacgugcauggagagcgucaagaacgggaccuacgacuacccgaaguacuccgaggaggccaagcucaaccgggaggagaucgacggcgugaagcuggagucgacccgcaucuaccagauccuggcgaucuacuccaccguggccagcucgcucguccugguggugucccugggggccaucagcuucuggaugugcuccaacggcagccuccagugccggaucugcaucuga

SEQ ID NO: 4072 - RNA, 1701 nt, Artificial Sequence
  derived and/or modified CDS sequence (AUadapt) from InfluenzaA__ACZ96069__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccgggaacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 4073 - RNA, 1701 nt, Artificial Sequence; identical to SEQ ID NO: 4060
  derived and/or modified CDS sequence (AUadapt) from InfluenzaA__ACZ96089__HA

SEQ ID NO: 4074 - RNA, 1701 nt, Artificial Sequence
  derived and/or modified CDS sequence (AUadapt) from InfluenzaA__ACZ96119__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagauguuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 4075 - RNA, 1701 nt, Artificial Sequence
  derived and/or modified CDS sequence (AUadapt) from InfluenzaA__ACZ96129__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgaguucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 4076 - RNA, 1701 nt, Artificial Sequence; identical to SEQ ID NO: 116
  derived and/or modified CDS sequence (AUadapt) from InfluenzaA__ACZ96149__HA

SEQ ID NO: 4077 - RNA, 1701 nt, Artificial Sequence; identical to SEQ ID NO: 116
  derived and/or modified CDS sequence (AUadapt) from InfluenzaA__ACZ96159__HA

SEQ ID NO: 4078 - RNA, 1701 nt, Artificial Sequence
  derived and/or modified CDS sequence (AUadapt) from InfluenzaA__ACZ96179__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 4079 - RNA, 1701 nt, Artificial Sequence; identical to SEQ ID NO: 4071
  derived and/or modified CDS sequence (AUadapt) from InfluenzaA__ACZ96189__HA

SEQ ID NO: 4080 - RNA, 1701 nt, Artificial Sequence; identical to SEQ ID NO: 4078
  derived and/or modified CDS sequence (AUadapt) from InfluenzaA__ACZ96199__HA

SEQ ID NO: 4081 - RNA, 1701 nt, Artificial Sequence; identical to SEQ ID NO: 116
  derived and/or modified CDS sequence (AUadapt) from InfluenzaA__ACZ96209__HA

SEQ ID NO: 4082 - RNA, 1701 nt, Artificial Sequence
  derived and/or modified CDS sequence (AUadapt) from InfluenzaA__ACZ96219__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaaguucgaggcgaccggcaaccucguggucccccgguacgccuucgccauggagcgcaacgccggguccggcaucaucaucucggacacccccgugcacgacugcaacacgaccugccagaccuccaagggcgccaucaacaccagccugccguuccagaacauccaccccaucacgaucgggaagugccccaaguacgugaaguccaccaagcugcggcucgcgaccggccugcgcaacguccccucgauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuacccgaaguacucggaggaggccaagcugaaccgggaggagaucgcgggcgugaagcucgaguccacccgcaucuaccagauccuggccaucuacagcaccgucgccucgucccuggugcucguggucagccugggggccaucuccuucuggaugugcagcaacggcucccugcagugccggaucugcaucuga

SEQ ID NO: 4083 - RNA, 1701 nt, Artificial Sequence; identical to SEQ ID NO: 116
  derived and/or modified CDS sequence (AUadapt) from InfluenzaA__ACZ96229__HA

SEQ ID NO: 4084 - RNA, 1701 nt, Artificial Sequence; identical to SEQ ID NO: 4078
  derived and/or modified CDS sequence (AUadapt) from InfluenzaA__ACZ96239__HA

SEQ ID NO: 4085 - RNA, 1701 nt, Artificial Sequence; identical to SEQ ID NO: 116
  derived and/or modified CDS sequence (AUadapt) from InfluenzaA__ACZ96249__HA

SEQ ID NO: 4086 - RNA, 1701 nt, Artificial Sequence
  derived and/or modified CDS sequence (AUadapt) from InfluenzaA__ACZ96269__HA
augaaggccauccuggugguccuccuguacaccuucgccaccgcgaacgccgacacgcugugcaucggcuaccacgccaacaacucgaccgacaccguggacaccgugcucgagcgcaacgucacggugacccacuccgugaaccugcuggaggacaagcacaacgggaagcucugcaagcugcggggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgcgagcagcugucguccgugagcuccuucgagcgguucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgcuacucgaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggcgaucuacuccaccgucgccucgagccuggugcucguggucucccugggggccaucucguucuggaugugcuccaacggcagccugcagugccgcaucugcaucuga

SEQ ID NO: 4087 - RNA, 1701 nt, Artificial Sequence; identical to SEQ ID NO: 116
  derived and/or modified CDS sequence (AUadapt) from InfluenzaA__ACZ96299__HA

SEQ ID NO: 4088 - RNA, 1701 nt, Artificial Sequence; identical to SEQ ID NO: 116
  derived and/or modified CDS sequence (AUadapt) from InfluenzaA__ACZ96309__HA

SEQ ID NO: 4089 - RNA, 1701 nt, Artificial Sequence
  derived and/or modified CDS sequence (AUadapt) from InfluenzaA__ACZ96319__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaucugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgacccgcaucuaccagauccuggcgaucuacuccaccgucgccagcucgcuggugcucguggucucccugggggccaucagcuucuggaugugcuccaacggcagccugcagugccggaucugcaucuga

SEQ ID NO: 4090 - RNA, 1701 nt, Artificial Sequence; identical to SEQ ID NO: 4089
  derived and/or modified CDS sequence (AUadapt) from InfluenzaA__ACZ96329__HA

SEQ ID NO: 4091 - RNA, 1701 nt, Artificial Sequence
  derived and/or modified CDS sequence (AUadapt) from InfluenzaA__ACZ96339__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacuccuacguguucgugggcacgagccgguacuccaagaaguucaagcccgagaucgccauccgcccgaagguccgggaccaggagggccgcaugaacuacuacuggacccugguggagcccggggacaagaucaccuucgaggccaccggcaaccucguggucccccgguacgcguucgccauggagcgcaacgccgggucgggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgucgauccagucccgggggcuguucggcgcgaucgccggguucaucgagggcggcuggacggggaugguggacggcugguacggguaccaccaccagaacgagcagggcagcggguacgccgccgaccucaaguccacccagaacgccaucgacgagaucaccaacaaggugaacucggucaucaagaagaugaacacccaguucacggcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggccaucuacagcaccgucgcgucgucccuggugcucguggucagccugggggccaucuccuucuggaugugcagcaacggcucccugcagugccggaucugcaucuga

SEQ ID NO: 4092 - RNA, 1701 nt, Artificial Sequence; identical to SEQ ID NO: 116
  derived and/or modified CDS sequence (AUadapt) from InfluenzaA__ACZ96349__HA

SEQ ID NO: 4093 - RNA, 1701 nt, Artificial Sequence; identical to SEQ ID NO: 4089
  derived and/or modified CDS sequence (AUadapt) from InfluenzaA__ACZ96359__HA

SEQ ID NO: 4094 - RNA, 1701 nt, Artificial Sequence; identical to SEQ ID NO: 116
  derived and/or modified CDS sequence (AUadapt) from InfluenzaA__ACZ96372__HA

SEQ ID NO: 4095 - RNA, 1701 nt, Artificial Sequence; identical to SEQ ID NO: 4089
  derived and/or modified CDS sequence (AUadapt) from InfluenzaA__ACZ96382__HA

SEQ ID NO: 4096 - RNA, 1701 nt, Artificial Sequence; identical to SEQ ID NO: 62
  derived and/or modified CDS sequence (AUadapt) from InfluenzaA__ACZ96392__HA

SEQ ID NO: 4097 - RNA, 1701 nt, Artificial Sequence; identical to SEQ ID NO: 3156
  derived and/or modified CDS sequence (AUadapt) from InfluenzaA__ACZ96405__HA

SEQ ID NO: 4098 - RNA, 1701 nt, Artificial Sequence; identical to SEQ ID NO: 116
  derived and/or modified CDS sequence (AUadapt) from InfluenzaA__ACZ96415__HA

SEQ ID NO: 4099 - RNA, 1701 nt, Artificial Sequence; identical to SEQ ID NO: 116
  derived and/or modified CDS sequence (AUadapt) from InfluenzaA__ACZ96425__HA

SEQ ID NO: 4100 - RNA, 1701 nt, Artificial Sequence
  derived and/or modified CDS sequence (AUadapt) from InfluenzaA__ACZ96435__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcccagcugcaccucgggaagugcaacaucgccggcuggauccuggggaaccccgagugcgagucgcuguccaccgcgagcuccuggucguacaucguggagaccuccagcuccgacaacggcacgugcuacccgggcgacuucaucgacuacgaggagcuccgggagcagcugucguccgugagcuccuucgagcgcuucgagaucuuccccaagaccucguccuggcccaaccacgacagcaacaagggggucaccgccgccugcccccacgccggcgcgaaguccuucuacaagaaccugaucuggcucgugaagaaggggaacucguacccgaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgccccaagguccgggaccaggagggccgcaugaacuacuacuggacccugguggagccgggggacaagaucaccuucgaggcgaccggcaaccucauggugccccgguacgccuucgccauggagcgcaacgccggguccggcaucaucaucagcgacacgcccguccacgacugcaacacgaccugccagacccccaagggcgccaucaacaccucccugccguuccagaacauccaccccaucaccaucgggaagugccccaaguacgucaagucgaccaagcugcggcucgcgaccggccugcgcaacgugcccuccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuacccgaaguacuccgaggaggccaagcugaaccgggaggagaucgacggcgugaagcucgagagcacccgcaucuaccagauccuggcgaucuacuccaccguggccucgagccugguccucguggugucccugggggccaucucguucuggaugugcuccaacggcagccugcagugccggaucugcaucuga

SEQ ID NO: 4101 - RNA, 1701 nt, Artificial Sequence; identical to SEQ ID NO: 116
  derived and/or modified CDS sequence (AUadapt) from InfluenzaA__ACZ96445__HA

SEQ ID NO: 4102 - RNA, 1701 nt, Artificial Sequence
  derived and/or modified CDS sequence (AUadapt) from InfluenzaA__ACZ96476__HA
augaaggccauccuggugguccuccuguacaccuucgccaccgcguacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgacccgcaucuaccagauccuggcgaucuacuccaccgucgccagcucgcuggugcucguggucucccugggggccaucagcuucuggaugugcuccaacggcagccugcagugccggaucugcaucuga

SEQ ID NO: 4103 - RNA, 1701 nt, Artificial Sequence; identical to SEQ ID NO: 116
  derived and/or modified CDS sequence (AUadapt) from InfluenzaA__ACZ96496__HA

SEQ ID NO: 4104 - RNA, 1701 nt, Artificial Sequence; identical to SEQ ID NO: 116
  derived and/or modified CDS sequence (AUadapt) from InfluenzaA__ACZ96506__HA

SEQ ID NO: 4105 - RNA, 1701 nt, Artificial Sequence; identical to SEQ ID NO: 116
  derived and/or modified CDS sequence (AUadapt) from InfluenzaA__ACZ96526__HA

SEQ ID NO: 4106 - RNA, 1701 nt, Artificial Sequence
  derived and/or modified CDS sequence (AUadapt) from InfluenzaA__ACZ96536__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcucaagggcgucgcgccccugcaccuggggaagugcaacaucgccggcuggauccucgggaacccggagugcgagucgcuguccaccgccagcuccuggucguacaucguggagaccuccagcuccgacaacggcacgugcuaccccggcgacuucaucgacuacgaggagcugcgcgagcagcucucguccgugagcuccuucgagcgguucgagaucuuccccaagaccucguccuggcccaaccacgacagcaacaagggggucaccgccgccugcccgcacgccggcgcgaaguccuucuacaagaaccugaucuggcuggugaagaaggggaacucguaccccaagcucuccaagagcuacaucaacgacaagggcaaggaggugcugguccugugggggauccaccaccccucgaccuccgccgaccagcagagccucuaccagaacgccgacacguacguguucgugggcuccucgaaguacuccaagaaguucaagcccgagaucgccauccgcccgaagguccgggaccaggagggccgcaugaacuacuacuggacccugguggagcccggggacaagaucaccuucgaggccaccggcaaccugguggucccccgguacgcguucgccauggagcgcaacgccgggagcggcaucaucaucuccgacacgcccgugcacgacugcaacacgaccugccagaccccgaagggcgccaucaacaccucgcuccccuuccagaacauccaccccaucaccaucgggaagugccccaagcacgugaaguccaccaagcugcggcuggccaccggccuccgcaacgucccgagcauccagucccgggggcuguucggcgcgaucgccggguucaucgagggcggcuggacggggaugguggacggcugguacggguaccaccaccagaacgagcagggcucgggguacgccgccgaccugaaguccacccagaacgccaucgacgagaucaccaacaaggugaacagcgucaucgagaagaugaacacccaguucacggcggugggcaaggaguucaaccaccucgagaagcgcaucgagaaccugaacaagaaggucgacgacggcuuccuggacaucuggaccuacaacgccgagcuccuggugcugcucgagaacgagcggacccuggacuaccacgacuccaacgugaagaaccuguacgagaagguccgcucgcagcucaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcuggaguccacccgcaucuaccagauccucgccaucuacucgaccgucgcgagcucccuggugcugguggucucgcucggggccaucuccuucuggaugugcagcaacggcucccugcagugccggaucugcaucuga

SEQ ID NO: 4107 - RNA, 1701 nt, Artificial Sequence; identical to SEQ ID NO: 116
  derived and/or modified CDS sequence (AUadapt) from InfluenzaA__ACZ96549__HA

SEQ ID NO: 4108 - RNA, 1701 nt, Artificial Sequence
  derived and/or modified CDS sequence (AUadapt) from InfluenzaA__ACZ96559__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 4109 - RNA, 1701 nt, Artificial Sequence
  derived and/or modified CDS sequence (AUadapt) from InfluenzaA__ACZ96569__HA
auggaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucaacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccacaacauccaccccaucacgaucgggaagugccccaaguacgugaaguccaccaagcugcggcucgcgaccggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 4110 - RNA, 1701 nt, Artificial Sequence
  derived and/or modified CDS sequence (AUadapt) from InfluenzaA__ACZ96579__HA
auggaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcuccagcgccgaccagcagucccuguaccagaacgccgacgccuacguguucgugggcucgucccgguacagcaagaaguucaagcccgagaucgccauccgcccgaagguccgggaccaggagggccgcaugaacuacuacuggacccugguggagcccggggacaagaucacguucgaggcgaccggcaaccucguggucccccgguacgccuucgccauggagcgcaacgccggguccggcaucaucaucucggacacccccgugcacgacugcaacaccacgugccagaccccgaagggcgccaucaacaccucccugcccuuccacaacauccaccccaucaccaucgggaagugccccaaguacgucaagagcacgaagcugcggcucgcgaccggccugcgcaacgugccguccauccagucgcgggggcuguucggcgccaucgccggguucaucgagggcggcuggaccgggaugguggacggcugguacggguaccaccaccagaacgagcagggcuccggguacgccgccgaccucaagagcacccagaacgcgaucgacgagaucacgaacaaggugaacuccgucaucgagaagaugaacacccaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacucgaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgacccgcaucuaccagauccuggcgaucuacagcaccgucgccuccucgcuggugcucguggucucccugggggccaucagcuucuggaugugcuccaacggcagccugcagugccggaucugcaucuga

SEQ ID NO: 4111 - RNA, 1701 nt, Artificial Sequence; identical to SEQ ID NO: 116
  derived and/or modified CDS sequence (AUadapt) from InfluenzaA__ACZ96589__HA

SEQ ID NO: 4112 - RNA, 1701 nt, Artificial Sequence
  derived and/or modified CDS sequence (AUadapt) from InfluenzaA__ACZ96599__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacacgggguccggcaucaucaucucggacacccccgugcacgacugcaacacgaccugccagaccccgaagggcgccaucaacaccucccugcccuuccagaacauccacagcaucaccaucgggaagugccccaaguacgugaaguccaccaagcugcggcucgccacgggccugcgcaacguccccucgauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacgagaucaccaacaaggugaacucggucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuacccgaaguacucggaggaggccaagcugaaccgggaggagaucgacggcgugaagcucgaguccacccgcaucuaccagauccuggccaucuacagcaccgucgcgucgucccuggugcucguggucagccugggggccaucuccuucuggaugugcagcaacggcucccugcagugccggaucugcaucuga

SEQ ID NO: 4113 - RNA, 1701 nt, Artificial Sequence
  derived and/or modified CDS sequence (AUadapt) from InfluenzaA__ACZ96609__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucaacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccagaacauccaccccaucacgaucgggaccugccccaaguacgugaaguccaccaagcugcggcucgcgaccggccugcgcaacgucccgucgauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacucggucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 4114 - RNA, 1701 nt, Artificial Sequence; identical to SEQ ID NO: 96
  derived and/or modified CDS sequence (AUadapt) from InfluenzaA__ACZ96619__HA

SEQ ID NO: 4115 - RNA, 1701 nt, Artificial Sequence; identical to SEQ ID NO: 96
  derived and/or modified CDS sequence (AUadapt) from InfluenzaA__ACZ96629__HA

SEQ ID NO: 4116 - RNA, 1701 nt, Artificial Sequence; identical to SEQ ID NO: 96
  derived and/or modified CDS sequence (AUadapt) from InfluenzaA__ACZ96639__HA

SEQ ID NO: 4117 - RNA, 1701 nt, Artificial Sequence; identical to SEQ ID NO: 96
  derived and/or modified CDS sequence (AUadapt) from InfluenzaA__ACZ96649__HA

SEQ ID NO: 4118 - RNA, 1701 nt, Artificial Sequence; identical to SEQ ID NO: 96
  derived and/or modified CDS sequence (AUadapt) from InfluenzaA__ACZ96659__HA

SEQ ID NO: 4119 - RNA, 1701 nt, Artificial Sequence; identical to SEQ ID NO: 96
  derived and/or modified CDS sequence (AUadapt) from InfluenzaA__ACZ96669__HA

SEQ ID NO: 4120 - RNA, 1701 nt, Artificial Sequence; identical to SEQ ID NO: 96
  derived and/or modified CDS sequence (AUadapt) from InfluenzaA__ACZ96679__HA

SEQ ID NO: 4121 - RNA, 1701 nt, Artificial Sequence; identical to SEQ ID NO: 96
  derived and/or modified CDS sequence (AUadapt) from InfluenzaA__ACZ96689__HA

SEQ ID NO: 4122 - RNA, 1701 nt, Artificial Sequence; identical to SEQ ID NO: 96
  derived and/or modified CDS sequence (AUadapt) from InfluenzaA__ACZ96699__HA

SEQ ID NO: 4123 - RNA, 1701 nt, Artificial Sequence; identical to SEQ ID NO: 96
  derived and/or modified CDS sequence (AUadapt) from InfluenzaA__ACZ96719__HA

SEQ ID NO: 4124 - RNA, 1701 nt, Artificial Sequence; identical to SEQ ID NO: 96
  derived and/or modified CDS sequence (AUadapt) from InfluenzaA__ACZ96729__HA

SEQ ID NO: 4125 - RNA, 1701 nt, Artificial Sequence; identical to SEQ ID NO: 96
  derived and/or modified CDS sequence (AUadapt) from InfluenzaA__ACZ96739__HA

SEQ ID NO: 4126 - RNA, 1701 nt, Artificial Sequence
  derived and/or modified CDS sequence (AUadapt) from InfluenzaA__ACZ96749__HA
augaagaccauccuggugguccuccuguacaccuucgccacggccaacgcggacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagacguccucguccgacaacgggaccugcuaccccggcgacuucaucgacuacgaggagcuccgggagcagcugagcuccgugucguccuucgagcgcuucgagaucuuccccaagaccagcuccuggcccaaccacgacucgaacaagggcgucaccgccgccugcccgcacgccggcgccaaguccuucuacaagaaccugaucuggcucgugaagaaggggaacagcuaccccaagcuguccaagucguacaucaacgacaagggcaaggaggugcugguccucugggggauccaccaccccagcacguccgcggaccagcagucgcuguaccagaacgccgacgccuacguguucgugggcuccagccgguacuccaagaaguucaagcccgagaucgccauccgcccgaagguccgggaccaggagggccgcaugaacuacuacuggacccugguggagcccggggacaagaucaccuucgaggccaccggcaaccucguggucccccgguacgcguucgccauggagcgcaacgccgggucgggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgccaccggccugcgcaacgucccgucgauccagucccgggggcuguucggcgcgaucgccggguucaucgagggcggcuggacggggaugguggacggcugguacggguaccaccaccagaacgagcagggcagcggguacgccgccgaccucaaguccacccagaacgccaucgacgagaucaccaacaaggugaacucggucaucgagaagaugaacacccaguucacggcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggccaucuacagcaccgucgcgucgucccuggugcucguggucagccugggggccaucuccuucuggaugugcagcaacggcucccugcagugccggaucugcaucuga

SEQ ID NO: 4127 - RNA, 1701 nt, Artificial Sequence; identical to SEQ ID NO: 62
  derived and/or modified CDS sequence (AUadapt) from InfluenzaA__ACZ96759__HA

SEQ ID NO: 4128 - RNA, 1701 nt, Artificial Sequence; identical to SEQ ID NO: 62
  derived and/or modified CDS sequence (AUadapt) from InfluenzaA__ACZ96769__HA

SEQ ID NO: 4129 - RNA, 1701 nt, Artificial Sequence; identical to SEQ ID NO: 62
  derived and/or modified CDS sequence (AUadapt) from InfluenzaA__ACZ96779__HA

SEQ ID NO: 4130 - RNA, 1701 nt, Artificial Sequence; identical to SEQ ID NO: 62
  derived and/or modified CDS sequence (AUadapt) from InfluenzaA__ACZ96789__HA

SEQ ID NO: 4131 - RNA, 1701 nt, Artificial Sequence
  derived and/or modified CDS sequence (AUadapt) from InfluenzaA__ACZ96809__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccaacgccgaccagcagucccuguaccagaacgccgacgccuacguguucgugggcacgucgcgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccucgcugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcucgggguacgccgccgaccucaaguccacccagaacgcgaucgacgagaucaccaacaaggugaacagcgucaucgagaagaugaacacccaguucgccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggcgaagcugaaccgggaggagaucgacggcgugaagcucgaguccacccgcaucuaccagauccuggccaucuacucgaccgucgccuccagccuggugcucguggucucgcugggggccaucuccuucuggaugugcagcaacggcucccugcagugccggaucugcaucuga

SEQ ID NO: 4132 - RNA, 1701 nt, Artificial Sequence; identical to SEQ ID NO: 62
  derived and/or modified CDS sequence (AUadapt) from InfluenzaA__ACZ96819__HA

SEQ ID NO: 4133 - RNA, 1701 nt, Artificial Sequence; identical to SEQ ID NO: 62
  derived and/or modified CDS sequence (AUadapt) from InfluenzaA__ACZ96829__HA

SEQ ID NO: 4134 - RNA, 1701 nt, Artificial Sequence; identical to SEQ ID NO: 62
  derived and/or modified CDS sequence (AUadapt) from InfluenzaA__ACZ96839__HA

SEQ ID NO: 4135 - RNA, 1701 nt, Artificial Sequence; identical to SEQ ID NO: 4054
  derived and/or modified CDS sequence (AUadapt) from InfluenzaA__ACZ96849__HA

SEQ ID NO: 4136 - RNA, 1701 nt, Artificial Sequence; identical to SEQ ID NO: 116
  derived and/or modified CDS sequence (AUadapt) from InfluenzaA__ACZ96859__HA

SEQ ID NO: 4137 - RNA, 1701 nt, Artificial Sequence; identical to SEQ ID NO: 62
  derived and/or modified CDS sequence (AUadapt) from InfluenzaA__ACZ96869__HA

SEQ ID NO: 4138 - RNA, 1701 nt, Artificial Sequence; identical to SEQ ID NO: 62
  derived and/or modified CDS sequence (AUadapt) from InfluenzaA__ACZ96879__HA

SEQ ID NO: 4139 - RNA, 1701 nt, Artificial Sequence
  derived and/or modified CDS sequence (AUadapt) from InfluenzaA__ACZ96899__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccacagcuccaccagcgccgaccagcagucccuguaccagaacgccgacgccuacguguucgugggcucgucccgguacagcaagaaguucaagcccgagaucgccauccgccccaagguccgggaccaggagggccgcaugaacuacuacuggacgcugguggagccgggggacaagaucaccuucgaggcgaccggcaaccucguggucccccgguacgccuucgccauggagcgcaacgccggguccggcaucaucaucucggacacccccgugcacgacugcaacacgaccugccagacccccaagggcgccaucaacaccucccugccguuccagaacauccaccccaucacgaucgggaagugccccaaguacgucaagagcaccaagcugcggcucgcgaccggccugcgcaacgugcccuccauccagucgcgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacacgugcauggagagcgugaagaacgggaccuacgacuacccgaaguacuccgaggaggccaagcugaaccgggaggagaucgacggcgugaagcucgagucgacccgcaucuaccagauccuggcgaucuacagcaccgucgccuccucgcuggugcucguggucucccugggggccaucagcuucuggaugugcuccaacggcagccugcagugccggaucugcaucuga

SEQ ID NO: 4140 - RNA, 1701 nt, Artificial Sequence; identical to SEQ ID NO: 62
  derived and/or modified CDS sequence (AUadapt) from InfluenzaA__ACZ96909__HA

SEQ ID NO: 4141 - RNA, 1701 nt, Artificial Sequence; identical to SEQ ID NO: 62
  derived and/or modified CDS sequence (AUadapt) from InfluenzaA__ACZ96919__HA

SEQ ID NO: 4142 - RNA, 1701 nt, Artificial Sequence; identical to SEQ ID NO: 62
  derived and/or modified CDS sequence (AUadapt) from InfluenzaA__ACZ96929__HA

SEQ ID NO: 4143 - RNA, 1701 nt, Artificial Sequence; identical to SEQ ID NO: 62
  derived and/or modified CDS sequence (AUadapt) from InfluenzaA__ACZ96939__HA

SEQ ID NO: 4144 - RNA, 1701 nt, Artificial Sequence
  derived and/or modified CDS sequence (AUadapt) from InfluenzaA__ACZ96949__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcgcaucgagaaccugaacaagaaggucgacgacggcuuccucgacaucuggacguacaacgccgagaugcuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcuggaguccacccgcaucuaccagauccucgcgaucuacagcaccgucgccucgucccuggugcugguggucagccucggggccaucuccuucuggaugugcagcaacggcucccugcagugccggaucugcaucuga

SEQ ID NO: 4145 - RNA, 1701 nt, Artificial Sequence; identical to SEQ ID NO: 62
  derived and/or modified CDS sequence (AUadapt) from InfluenzaA__ACZ97021__HA

SEQ ID NO: 4146 - RNA, 1701 nt, Artificial Sequence; identical to SEQ ID NO: 3268
  derived and/or modified CDS sequence (AUadapt) from InfluenzaA__ACZ97343__HA

SEQ ID NO: 4147 - RNA, 1701 nt, Artificial Sequence; identical to SEQ ID NO: 3268
  derived and/or modified CDS sequence (AUadapt) from InfluenzaA__ACZ97353__HA

SEQ ID NO: 4148 - RNA, 1701 nt, Artificial Sequence; identical to SEQ ID NO: 62
  derived and/or modified CDS sequence (AUadapt) from InfluenzaA__ACZ97363__HA

SEQ ID NO: 4149 - RNA, 1701 nt, Artificial Sequence
  derived and/or modified CDS sequence (AUadapt) from InfluenzaA__ACZ97383__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccacgagcgacaacgggaccugcuaccccggcgacuucaucgacuacgaggagcuccgggagcagcuguccucgguguccagcuucgagcgcuucgagaucuuccccaagaccuccucguggcccaaccacgacuccaacaagggcgucaccgccgccugcccgcacgccggcgccaagagcuucuacaagaaccugaucuggcucgugaagaaggggaacuccuaccccaagcugucgaaguccuacaucaacgacaagggcaaggaggugcugguccucugggggauccaccaccccagcacgucggccgaccagcagucccuguaccagaacgccgacgccuacguguucgugggcagcucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 4150 - RNA, 1701 nt, Artificial Sequence; identical to SEQ ID NO: 62
  derived and/or modified CDS sequence (AUadapt) from InfluenzaA__ACZ97393__HA

SEQ ID NO: 4151 - RNA, 1701 nt, Artificial Sequence
  derived and/or modified CDS sequence (AUadapt) from InfluenzaA__ACZ98178__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacuacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccaccgccugcccgcacgccggcgccaaguccuucuacaagaaccugaucuggcucgugaagaaggggaacagcuaccccaagcuguccaagucguacaucaacgacaagggcaaggaggugcugguccucugggggauccaccaccccagcacguccgcggaccagcagucgcuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucucggacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagucgcgggggcuguucggcgcgaucgccggguucaucgagggcggcuggaccgggaugguggacggcugguacggguaccaccaccagaacgagcagggcuccggguacgccgccgaccucaagagcacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgacccgcaucuaccagauccuggccaucuacuccaccgucgcgagcucgcuggugcucguggucucccugggggccaucagcuucuggaugugcuccaacggcagccugcagugccggaucugcaucuga

SEQ ID NO: 4152 - RNA, 1701 nt, Artificial Sequence; identical to SEQ ID NO: 62
  derived and/or modified CDS sequence (AUadapt) from InfluenzaA__ACZ98188__HA

SEQ ID NO: 4153 - RNA, 1701 nt, Artificial Sequence; identical to SEQ ID NO: 96
  derived and/or modified CDS sequence (AUadapt) from InfluenzaA__ACZ98198__HA

SEQ ID NO: 4154 - RNA, 1701 nt, Artificial Sequence; identical to SEQ ID NO: 116
  derived and/or modified CDS sequence (AUadapt) from InfluenzaA__ACZ98208__HA

SEQ ID NO: 4155 - RNA, 1701 nt, Artificial Sequence; identical to SEQ ID NO: 116
  derived and/or modified CDS sequence (AUadapt) from InfluenzaA__ACZ98218__HA

SEQ ID NO: 4156 - RNA, 1701 nt, Artificial Sequence; identical to SEQ ID NO: 116
  derived and/or modified CDS sequence (AUadapt) from InfluenzaA__ACZ98228__HA

SEQ ID NO: 4157 - RNA, 1701 nt, Artificial Sequence; identical to SEQ ID NO: 116
  derived and/or modified CDS sequence (AUadapt) from InfluenzaA__ACZ98238__HA

SEQ ID NO: 4158 - RNA, 1701 nt, Artificial Sequence; identical to SEQ ID NO: 3543
  derived and/or modified CDS sequence (AUadapt) from InfluenzaA__ACZ98248__HA

SEQ ID NO: 4159 - RNA, 1701 nt, Artificial Sequence; identical to SEQ ID NO: 116
  derived and/or modified CDS sequence (AUadapt) from InfluenzaA__ACZ98258__HA

SEQ ID NO: 4160 - RNA, 1701 nt, Artificial Sequence; identical to SEQ ID NO: 116
  derived and/or modified CDS sequence (AUadapt) from InfluenzaA__ACZ98268__HA

SEQ ID NO: 4161 - RNA, 1701 nt, Artificial Sequence; identical to SEQ ID NO: 4054
  derived and/or modified CDS sequence (AUadapt) from InfluenzaA__ACZ98278__HA

SEQ ID NO: 4162 - RNA, 1701 nt, Artificial Sequence; identical to SEQ ID NO: 4054
  derived and/or modified CDS sequence (AUadapt) from InfluenzaA__ACZ98288__HA

SEQ ID NO: 4163 - RNA, 1701 nt, Artificial Sequence
  derived and/or modified CDS sequence (AUadapt) from InfluenzaA__ACZ98298__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagaaguucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggucgggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgucgauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacggcaucaccaacaaggugaacucggucaucgagaagaugaacacccaguucaccgccgugggcaaggaguucaaccaccuggagaagcggaucgagaaccugaacaagaaggucgacgacggguuccucgacaucuggacguacaacgccgagcugcuggugcuccuggagaacgagcgcacccuggacuaccacgacuccaacgugaagaaccucuacgagaagguccggagccagcugaagaacaacgccaaggagaucggcaacgggugcuucgaguucuaccacaagugcgacaacacgugcauggaguccgugaagaacggcaccuacgacuaccccaaguacucggaggaggccaagcugaaccgcgaggagaucgacggggugaagcucgaguccacccggaucuaccagauccuggcgaucuacagcaccgucgccucgucccuggugcucguggucagccugggcgccaucuccuucuggaugugcagcaacggcucccugcagugccgcaucugcaucuga

SEQ ID NO: 4164 - RNA, 1701 nt, Artificial Sequence
  derived and/or modified CDS sequence (AUadapt) from InfluenzaA__ACZ98318__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccacauccuggcgaucuacuccaccgucgccucgagccuggugcucguggucucccugggggccaucucguucuggaugugcuccaacggcagccugcagugccggaucugcaucuga

SEQ ID NO: 4165 - RNA, 1701 nt, Artificial Sequence; identical to SEQ ID NO: 3156
  derived and/or modified CDS sequence (AUadapt) from InfluenzaA__ACZ98328__HA

SEQ ID NO: 4166 - RNA, 1701 nt, Artificial Sequence; identical to SEQ ID NO: 116
  derived and/or modified CDS sequence (AUadapt) from InfluenzaA__ACZ98338__HA

SEQ ID NO: 4167 - RNA, 1701 nt, Artificial Sequence; identical to SEQ ID NO: 4054
  derived and/or modified CDS sequence (AUadapt) from InfluenzaA__ACZ98348__HA

SEQ ID NO: 4168 - RNA, 1701 nt, Artificial Sequence; identical to SEQ ID NO: 116
  derived and/or modified CDS sequence (AUadapt) from InfluenzaA__ACZ98358__HA

SEQ ID NO: 4169 - RNA, 1701 nt, Artificial Sequence; identical to SEQ ID NO: 116
  derived and/or modified CDS sequence (AUadapt) from InfluenzaA__ACZ98368__HA

SEQ ID NO: 4170 - RNA, 1701 nt, Artificial Sequence; identical to SEQ ID NO: 3156
  derived and/or modified CDS sequence (AUadapt) from InfluenzaA__ACZ98388__HA

SEQ ID NO: 4171 - RNA, 1701 nt, Artificial Sequence; identical to SEQ ID NO: 116
  derived and/or modified CDS sequence (AUadapt) from InfluenzaA__ACZ98398__HA

SEQ ID NO: 4172 - RNA, 1701 nt, Artificial Sequence; identical to SEQ ID NO: 116
  derived and/or modified CDS sequence (AUadapt) from InfluenzaA__ACZ98408__HA

SEQ ID NO: 4173 - RNA, 1701 nt, Artificial Sequence; identical to SEQ ID NO: 96
  derived and/or modified CDS sequence (AUadapt) from InfluenzaA__ACZ98418__HA

SEQ ID NO: 4174 - RNA, 1701 nt, Artificial Sequence; identical to SEQ ID NO: 116
  derived and/or modified CDS sequence (AUadapt) from InfluenzaA__ACZ98428__HA

SEQ ID NO: 4175 - RNA, 1701 nt, Artificial Sequence; identical to SEQ ID NO: 116
  derived and/or modified CDS sequence (AUadapt) from InfluenzaA__ACZ98438__HA

SEQ ID NO: 4176 - RNA, 1701 nt, Artificial Sequence; identical to SEQ ID NO: 116
  derived and/or modified CDS sequence (AUadapt) from InfluenzaA__ACZ98448__HA

SEQ ID NO: 4177 - RNA, 1701 nt, Artificial Sequence; identical to SEQ ID NO: 4054
  derived and/or modified CDS sequence (AUadapt) from InfluenzaA__ACZ98458__HA

SEQ ID NO: 4178 - RNA, 1701 nt, Artificial Sequence
  derived and/or modified CDS sequence (AUadapt) from InfluenzaA__ACZ98546__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacccgaacaagggggucaccgccgccugcccccacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacguguucgugggcacgucgcgguacuccaagaaguucaagccggagaucgccauccgccccaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgccggugcacgacugcaacacgaccugccagacccccaagggcgccaucaacaccucgcugcccuuccagaacauccaccccaucaccaucgggaagugcccgaaguacgugaaguccaccaagcugcggcucaccacgggccugcgcaacguccccagcauccaguaccgggggcuguucggcgcgaucaccggguucaucgagggcggcuggaccgggaugguggacggcugguacggguaccaccaccagaacgagcagggcuccggguacgccgccgaccucaagucgacccagaacgccaucgacgagaucacgaacaaggugaacuccgucaucgagaagaugaacacccaguucaccgccgugggcaaggaguucaaccaccuggagaagcgcaucgagaaccugaacaagaaggucgacgacggcuuccucgacaucuggaccuacaacgcggagcugcuggugcuccuggagaacgagcggacgcuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggccaucuacuccaccgucgccucgucccuggugcucguggucagccugggggcgaucucguucuggaugugcuccaacggcagccugcagugccggaucugcaucuga

SEQ ID NO: 4179 - RNA, 1701 nt, Artificial Sequence
  derived and/or modified CDS sequence (AUadapt) from InfluenzaA__ACZ98560__HA
augaaggccauccgcgugguccugcucuacaccuucgccaccgcgaacgccgacacgcugugcaucggcuaccacgccaacaacucgaccgacaccguggacaccgugcuggagaagaacgucacggugacccacuccgugaaccuccuggaggacaagcacaacgggaagcugugcaagcuccggggcgucgcgccccugcaccuggggaagugcaacaucgccggcuggauccucgggaacccggagugcgagucgcuguccaccgcgagcuccuggucguacaucguggagaccuccagcuccgacaacggcacgugcuaccccggcgacuucaucgacuacgaggagcugcgcgagcagcucucguccgugagcuccuucgagcgguucgagaucuuccccaagaccucguccuggcccaaccacgacccgaacaagggggucaccgccgccugcccccacgccggcgccaagagcuucuacaagaaccugaucuggcuggugaagaaggggaacuccuaccccaagcucucgaaguccuacaucaacgacaagggcaaggaggugcugguccugugggggauccaccaccccagcaccucggccgaccagcagucccucuaccagaacgccgacgccuacguguucgugggcacgagccgcuacuccaagaaguucaagccggagaucgccauccggcccaagguccgcgaccaggagggccggaugaacuacuacuggacccugguggagcccggggacaagaucaccuucgaggcgaccggcaaccugguggucccccgcuacgccuucgccauggagcggaacgccgggucgggcaucaucaucuccgacacgccggugcacgacugcaacacgaccugccagacccccaagggcgccaucaacaccagccuccccuuccagaacauccaccccaucaccaucgggaagugcccgaaguacgugaagucccccaagcugcgccuggcgaccggcaugcggaacguccccuucauccaguaccgcggccucuucggggccaucaccggguucaucgagggcggcuggacggggaugguggacggcugguacggguaccaccaccagaacgagcagggcucgggguacgccgccgaccugaaguccacccagaacgccaucgacgagaucaccaacaaggugaacagcgucaucgagaagaugaacacccaguucacggcggugggcaaggaguucaaccaccuggagaagcggaucgagaaccucaacaagaaggucgacgacggcuuccuggacaucuggaccuacaacgccgagcugcucgugcugcuggagaacgagcgcacccucgacuaccacgacuccaacgugaagaaccuguacgagaagguccggucgcagcugaagaacaacgccaaggagaucgggaacggcugcuucgaguucuaccacaagugcgacaacacgugcauggaguccgugaagaacgggaccuacgacuaccccaaguacagcgaggaggccaagcucaaccgcgaggagaucgacggcgugaagcuggaguccacccggaucuaccagauccuggccaucuacucgaccgucgcguccagccucgugcugguggucucccugggggccaucucguucuggaugugcagcaacggcucccuccagugccgcaucugcaucuga

SEQ ID NO: 4180 - RNA, 1701 nt, Artificial Sequence
  derived and/or modified CDS sequence (AUadapt) from InfluenzaA__ACZ98567__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgucguccuggagcuacaucguggagaccuccucguccgacaacggcacgugcuaccccggcgacuucaucgacuacgaggagcuccgggagcagcugagcuccgugagcuccuucgagcgcuucgagaucuuccccaagaccucguccuggcccaaccacgacccgaacaagggggucaccgccgccugcccccacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccagcgccgaccagcagucccuguaccagaacgccgacgccuacguguucgugggcacgucgcgguacuccaagaaguucaagccggagaucgccauccgccccaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgccggugcacgacugcaacacgaccugccagacccccaagggcgccaucaacaccucgcugcccuuccagaacauccaccccaucaccaucgggaagugcccgaaguacgugaagucccccaagcugcggcucgcgagcggcaugcgcaacguccccuucauccagucccgggggcuguucggcgccaucaccggguucaucgaggagggcuggaccggcaugguggacgggugguacggcuuccaccaccagaacgagcaggggucgggcuacgccgccgaccugaaguccacgcagaacgccaucgacgagaucaccaacaaggugaacagcgucaucgagaagaugaacacccaguucaccgcgguggggaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcagccagcucaagaacaacgccaaggagaucggcaacgggugcuucgaguucuaccacaagugcgacaacacgugcauggaguccgugaagaacggcaccuacgacuaccccaaguacucggaggaggccaagcugaaccgggaggagaucgacggggugaagcuggaguccacccgcaucuaccagauccucgccaucuacagcaccgucgcguccucgcuggugcugguggucagccucggcgccaucuccuucuggaugugcagcaacgggucccugcagugccggaucugcaucuga

SEQ ID NO: 4181 - RNA, 1701 nt, Artificial Sequence; identical to SEQ ID NO: 62
  derived and/or modified CDS sequence (AUadapt) from InfluenzaA__ACZ98671__HA

SEQ ID NO: 4182 - RNA, 1701 nt, Artificial Sequence; identical to SEQ ID NO: 62
  derived and/or modified CDS sequence (AUadapt) from InfluenzaA__ACZ98681__HA

SEQ ID NO: 4183 - RNA, 1701 nt, Artificial Sequence; identical to SEQ ID NO: 116
  derived and/or modified CDS sequence (AUadapt) from InfluenzaA__ACZ98691__HA

SEQ ID NO: 4184 - RNA, 1701 nt, Artificial Sequence
  derived and/or modified CDS sequence (AUadapt) from InfluenzaA__ADA60799__HA
augaaggccauccuggugguccuccuguacaccuucgccaccgcgaacgccgacacgcugugcaucggcuaccacgccaacaacucgaccgacaccguggacaccgugcucgagcgcaacgucacggugacccacuccgugaaccugcuggaggacaagcacaacgggaagcucugcaagcugcggggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgcgagcagcugucguccgugagcuccuucgagcgguucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgcuacucgaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcgccucgcgaccggccugcggaacaucccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgugaucgagaagaugaacacccaguucacggccgucggcaaggaguucaaccaccuggagaagcggaucgagaaccugaacaagaagguggacgacggcuuccucgacaucuggaccuacaacgccgagcugcugguccuccuggagaacgagcgcacccuggacuaccacgacagcaacgugaagaaccucuacgagaaggugcggucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgcgaggagaucgacggcgugaagcucgagagcacccggaucuaccagauccuggcgaucuacuccaccguggccucgagccugguccucguggugucccugggggccaucucguucuggaugugcuccaacggcagccugcagugccgcaucugcaucuga

SEQ ID NO: 4185 - RNA, 1701 nt, Artificial Sequence; identical to SEQ ID NO: 4078
  derived and/or modified CDS sequence (AUadapt) from InfluenzaA__ADA69302__HA

SEQ ID NO: 4186 - RNA, 1701 nt, Artificial Sequence; identical to SEQ ID NO: 4078
  derived and/or modified CDS sequence (AUadapt) from InfluenzaA__ADA69312__HA

SEQ ID NO: 4187 - RNA, 1701 nt, Artificial Sequence; identical to SEQ ID NO: 4078
  derived and/or modified CDS sequence (AUadapt) from InfluenzaA__ADA69322__HA

SEQ ID NO: 4188 - RNA, 1701 nt, Artificial Sequence; identical to SEQ ID NO: 4078
  derived and/or modified CDS sequence (AUadapt) from InfluenzaA__ADA69332__HA

SEQ ID NO: 4189 - RNA, 1701 nt, Artificial Sequence; identical to SEQ ID NO: 4015
  derived and/or modified CDS sequence (AUadapt) from InfluenzaA__ADA70329__HA

SEQ ID NO: 4190 - RNA, 1698 nt, Artificial Sequence
  derived and/or modified CDS sequence (AUadapt) from InfluenzaA__ADA71150__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccuggucgagaacagccacaacgggaagcugugccuccugaagggcaucgcgccccugcagcucgggaacugcuccguggccggcuggauccuggggaacccggagugcgagcugcucaucagcaaggaguccuggagcuacaucguggagaagcccaaccccgagaacgggaccugcuaccccggccacuucgccgacuacgaggagcugcgcgagcagcuguccucggucuccagcuucgagcgguucgagaucuucccgaaggaguccagcuggcccaaccacacggugaccgggguguccgccagcugcucccacaacggcgagucguccuucuaccgcaaccuccuguggcugaccgggaagaacggccucuaccccaaccugagcaaguccuacgccaacaacaaggagaaggagguccuggugcucuggggcgugcaccacccgcccagcaucagcaaccagaagacccuguaccacacggagaacgccuacgucuccguggugagcucccacuacucgcggaaguucacccccgagaucgccaagcgccccaagguccgggaccaggagggccgcaucaacuacuacuggacccugcucgagcccggcgacaccaucaucuucgaggccaacgggaaccugaucgcgccgcgguacgccuucgcccugucccgcggcuucgggagcggcaucaucaacuccaacgcccccauggacaagugcgacgccaagugccagacgccccagggcgcgaucaacagcucccuccccuuccagaacgugcacccggugaccaucggggagugccccaaguacguccggagcgccaagcugcgcauggugaccggccugcggaacauccccuccauccagucgcgcggccucuucggggccaucgccggguucaucgagggcggcuggaccgggaugguggacggcugguacggguaccaccaccagaacgagcagggcuccggguacgccgcggaccagaaguccacgcagaacgccaucaacggcaucaccaagaaggucaacagcgugaucgagaagaugaacacccaguucaccgccgucggcaaggaguucaacaagcuggagcggcgcauggagaaccugaacaagaagguggacgacggguucaucgacaucuggacguacaacgccgagcuccuggugcugcucgagaacgagcggacccuggacuuccacgacagcaacgucaagaaccuguacgagaaggugaagucccagcucaagaacaacgccaaggagaucggcaacgggugcuucgaguucuaccacaagugcaacgacgagugcauggagagcgugaagaacggcaccuacgacuaccccaaguacuccgaggagucgaagcugaaccgcgagaagaucgacggggucaagcuggagagcaugggcguguaccagauccucgcgaucuacuccaccguggccagcucccugguccugcucgugagccugggcgccaucuccuucuggaugugcagcaacgggucccugcagugccggaucugcaucuga

SEQ ID NO: 4191 - RNA, 1701 nt, Artificial Sequence
  derived and/or modified CDS sequence (AUadapt) from InfluenzaA__ADA71152__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgggaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucgucgccagcuccgggacgcuggaguucaacaacgagucguucaacuggaccggcgugacccagaacgggaccuccucggccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccucgggccggaucaccguguccacgaagcgcagccagcagaccgugaucccgaacaucggcucgcggccccgcguccggaacauccccucccgcaucagcaucuacuggaccaucgugaagcccggggacauccugcucaucaacuccaccggcaaccugaucgccccgcggggguacuucaagauccgcucgggcaaguccucgaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacucggagggccgggggcaggccgccgaccugaaguccacccaggcggccaucgaccagaucaacggcaagcugaaccgccucaucggcaagaccaacgagaaguuccaccagaucgagaaggaguucagcgaggucgaggggcggauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 4192 - RNA, 1698 nt, Artificial Sequence
  derived and/or modified CDS sequence (AUadapt) from InfluenzaA__ADA71154__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacagcgagugcgagcuccugaucuccaaggagagcugguccuacaucguggagaagccgaaccccgagaacgggaccugcuacuucggccacuucgccgacuacgaggagcugcgcgagcaguucgggagcguguccagcuucgagcgguucgagaucuuccccaaggaguccucguggcccaaccacacggucaccggcguguccgccagcugcucccacaacggggagagcuccuucuaccgcaaccuccuguggcugaccggcaagaacgggcucuacccgaaccugagcaaguccuacgccaacaacaaggagaaggaggugcugguccucuggggcgugcaccacccgcccagcaucaacgaccagaagacccuguaccacacggagaacgccuacgugagcgucguguccagccacuacucccggaaguucacccccgagaucgccaagcgccccaaggugcgggaccaggagggccgcaucaacuacuacuggacccugcucgagccccgggacaccaucaucuucgaggccaacgggaaccugaucgcgccccgcuacgccuucgcccugucgcggggcuucggguccggcaucaucaacagcaacgcccccauggacaagugcgacgccaagugccagacgccgcagggcgcgaucaacuccagccuccccuuccagaacguccaccccgugaccaucggggagugccccaaguacgugcgcuccgccaagcugcggauggucaccggccugcgcaacaucccgagcauccagucccggggccucuucggcgccaucgccggguucaucgagggcggcuggaccgggaugguggacggcugguacggguaccaccaccagaacgagcagggcagcggguacgccgcggaccagaaguccacgcagaacgccaucaacggcaucaccaacaaggugaacagcgucaucgagaagaugaacacccaguucaccgccgugggcaaggaguucaacaagcuggagcgccggauggagaaccugaacaagaaggucgacgacggguucaucgacaucuggacguacaacgccgagcuccuggugcugcucgagaacgagcgcacccuggacuuccacgacuccaacgugaagaaccuguacgagaaggucaagucgcagcucaagaacaacgccaaggagaucggcaacgggugcuucgaguucuaccacaagugcaacgacgagugcauggaguccgugaagaacggcaccuacgacuaccccaaguacagcgaggaguccaagcugaaccgggagaagaucgacggggugaagcuggagagcaugggcgucuaccagauccucgcgaucuacagcaccguggccuccagccuggugcugcucgucucccugggcgccaucagcuucuggaugugcuccaacgggagccugcagugccgcaucugcaucuga

SEQ ID NO: 4193 - RNA, 1698 nt, Artificial Sequence
  derived and/or modified CDS sequence (AUadapt) from InfluenzaA__ADA71158__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggagaccugguccuacaucguggagaagcccaaccccgagaacggcacgugcuaccccggccacuucgccgacuacgaggagcugcgcgagcagcucagcuccgugucguccuucgagcgguucgagaucuucccgaaggagagcuccuggcccaaccacaccgucaccggggugagcgccuccugcagccacaacggcgaguccucguucuaccgcaaccugcuguggcucaccgggaagaacggccuguaccccaaccuguccaagagcuacgccaacaacaaggagaaggaggugcucguccuguggggcgugcaccacccgcccuccaucaacgaccagcggacgcuguaccacaccgagaacgccuacgugagcgucgugagcucccacuacagccgcaaguucacccccgagaucgccaagcggcccaaggugcgcgaccaggaggggcggaucaacuacuacuggacccuccuggagccccgcgacacgaucaucuucgaggccaacggcaaccugaucgcgccgcgguacgccuucgcccucucccgcggguucggcucggggaucaucaacuccaacgcccccauggacaagugcgacgccaagugccagacgccccagggcgcgaucaacagcucccugcccuuccagaacguccacccggugaccaucggcgagugccccaaguacgugcggagcgccaagcugcgcauggucaccgggcuccggaacacccccuccauccagagccgcggccuguucggggccaucgccggcuucaucgagggcggguggaccggcaugguggacgggugguacggcuaccaccaccagaacgagcagggguccggcuacgccgcggaccagaaguccacccagaacgccaucaacgggaucaccaacaaggugaacucggucaucgagaagaugaacacgcaguucaccgccgugggcaaggaguucaacaagcuggagagccucauggacauccugaacaagaaggucgacgacggcuucaucgacaucuggaccuacaacgccgagcugcucgugcugcuggagaacgagcggacccucgacuuccacgacuccaacgugaagaaccuguacgagaaggucaagagccagcugaagaacaacgccaaggagaucgggaacggcugcuucgaguucuaccacaagugcaacgacgagugcauggaguccgugaagaacgggacguacgacuaccccaaguacagcgaggaguccaagcucaaccgcgagaagaucgacggcgugaagcuggagucgaugggggucuaccagauccuggcgaucuacagcaccguggccuccagccucgugcugcuggucucccucggcgccaucagcuucuggaugugcuccaacggcagccugcagugccggaucugcaucuga

SEQ ID NO: 4194 - RNA, 1701 nt, Artificial Sequence; identical to SEQ ID NO: 2679
  derived and/or modified CDS sequence (AUadapt) from InfluenzaA__ADA71162__HA

SEQ ID NO: 4195 - RNA, 1698 nt, Artificial Sequence
  derived and/or modified CDS sequence (AUadapt) from InfluenzaA__ADA71164__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccuggugagcaaggaguccuggagcuacaucguggagaagcccaaccccgagaacgggaccugcuaccccggccacuucgccgacuacgaggagcugcgcgagcagcucuccagcgucuccucguucgagcgguucgagaucuucccgaaggaguccagcuggcccaaccacacggugaccggggccuccgccagcugcucccacaacggcgagaacagcuucuaccgcaaccugcuguggcucaccgggaagaacggccuguaccccaaccuguccaagagcuacgccaacaacaaggagaaggaggugcucguccuguggggcgugcaccacccgcccuccaucgccgaccagaagacccuguaccacacggagaacgccuacgugucggucgugagcucccacuacagccggaaguucacccccgagaucgcgaagcgccccaaggugcgggaccaggagggccgcauccacuacuacuggacccuccuggagcccggcgacaccaucaucuucgaggccaacgggaaccugaucgccccgcgguacgccuucgcccucucccgcggcuucgggagcggcaucaucaacuccaacgcgcccauggacaagugcgacgccacgugccagacgccccagggcgccaucaacagcucccugcccuuccagaacguccacccggugaccaucggggagugccccaaguacgugcggucggccaagcugcgcauggucaccggccuccggaacauccccuccauccagagccgcgggcuguucggcgccaucgcgggguucaucgagggcggcuggaccgggaugguggacggcugguacggguaccaccaccagaacgagcagggcuccggguacgccgccgaccagaaguccacccagaacgccaucaacggcaucaccaacaaggugaacagcgucaucgagaagaugaacacccaguucacggccgugggcaaggaguucaacaagcuggagcggcgcauggagaaccucaacaagaaggucgacgacggguucaucgacaucuggaccuacaacgcggagcugcuggugcuccuggagaacgagcggacccuggacuuccacgacagcaacgugaagaaccucuacgagaaggucaucucccagcugaagaucaacgccaaggaccugggcuacgggugcuucgaguucuaccacaagugcaacgacgagugcauggagagcgugaagaacggcaccuacgacuaccccaaguacuccgaggagucgaagcucaaccgcgagaagaucgacggggugaagcuggaguccaugggcgucuaccagauccuggccaucuacagcacgguggccagcucccucgugcugcuggucagccucggcgccaucuccuucuggaugugcagcaacgggucccugcagugccggaucugcaucuga

SEQ ID NO: 4196 - RNA, 1698 nt, Artificial Sequence
  derived and/or modified CDS sequence (AUadapt) from InfluenzaA__ADA71168__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacaaccacaacgggaagcucugccugcugaagggcaaggcgccccuccagcuggggaacugcagcgucgccggcuggauccuggggaacccggagugcggccuccugaucuccaaggagagcugguccuacaucguggagcgccccaaccccgagaacgggaccugcuaccccgggcacuucgccgacuacgaggagcugcgggagcagcucagcuccgugucguccuucgagcgcuucgagaucuucccgaaggagagcuccuggcccaaccacacggucaccggcgugagcgccuccugcagccacaacggggaguccucguucuacaagaaccugcuguggcucaccggcaagaacgggcuguaccccaaccuguccaagagcuacgccaacaacaaggagaaggaggugcucguccuguggggcgugcaccacccgcccaacaucggcgugcagaugacccuguaccacaaggagaacgccuacgucuccguggugagcagccacuacucccggaaguucacgcccgagaucgucaagcgccccaaggugcgggaccaggaggggcgcaucaacuacuacuggacccuccuggagcccggcgacaccaucaucuucgaggccaacgggaaccugaucgccccgcgguacgcguucgcccucucgcgcggcuucggcuccgggaucaucaacagcaacgcccccauggacgagugcgacgccaagugccagacgccccagggcgccaucaacuccagccugcccuuccagaacgugcacccggucaccaucggggagugccccaaguacgugcgguccgcgaagcugcgcauggugaccggccuccggaacauccccagcauccagucccgcgggcuguucggcgccaucgccggcuucaucgagggcggcuggaccgggauggucgacggcugguacggguaccaccaccagaacgagcagggcucgggcuacgccgccgaccagaaguccacccagaacgcgaucaacgggaucacgaacaaggugaacagcgucaucgagaagaugaacacccaguucaccgccgugggcaaggaguucaacaagcuggagcggcgcauggagaaccucaacaagaagguggacgacggguucaucgacaucuggaccuacaacgccgagcugcugguccuccuggagaacgagcggacgcuggacuuccacgacuccaacgugaagaaccucuacgagaaggucaagagccagcugaagaacaacgccaaggagaucggcaacgggugcuucgaguucuaccacaagugcaacgacgagugcauggaguccgugaagaacggcaccuacgacuaccccaaguacagcgaggaguccaagcugaaccgcgagaagaucgacggcgugaagcucgagucgauggggguguaccagauccuggccaucuacuccaccgucgcgagcagccuggugcuccuggugucccugggcgccaucagcuucuggaugugcuccaacgggagccuccagugccggaucugcaucuga

SEQ ID NO: 4197 - RNA, 1698 nt, Artificial Sequence
  derived and/or modified CDS sequence (AUadapt) from InfluenzaA__ADA71170__HA
augaaggugaagcugcucguccugcugugcaccuucaccgccacguacgccgacaccaucugcaucggcuaccacgcgaacaacucgaccgacaccguggacacggugcucgagaagaacgggaccgucacccccuccggcaaccugguggagaacagcccgaacgggaagcugugccuccugaagggcaucaccccgcugcagcucgggaagugcuccguggccggcuggauccugggcaaccccaagugggagcugcucgucucgaaggaguccuggagcuacaucgggaagaagcccaaccccgagaacggcacgugcuaccccgggcacuuccccuacuacgaggagcugcgcgagcagcuguccucgguguccagcuucgagcgguucgagaucuuccccaaggaguccucguggccgaaccacaccgugaccggcgccuccgccagcugcucccacaacggggagaacagcuucuaccgcaaccuccuguggcugaccggcaagaacggccucuaccccaaccuguccaagucguacgccaacaacaaggagaaggagguccuggugcucuggggcgugcaccacccgcccaacaucgcggaccagaagacgcuguaccacaccgagaacgccuacgucuccguggugagcucgcacuacucccggaaguucacccccgagaucgccaagcgccccaagguccgggaccaggaggggcgcaucaacuacuacuggacccugcucgagcccggggacacgaucaucuucgaggccaacggcaaccugaucgcgccccgguacgccuucgcccugagccgcggcuucggguccggcaucaucaacucgaacgccccgauggacaagugcgacgccaagugccagacgccccagggggcgaucaacuccagccuccccuuccagaacgugcaccccgugaccaucggcgagugcccgaaguacguccgguccgccaagcugcgcauggugaccgggcugcggaacauccccucgauccagucccgcggccucuucggcgccaucgccggguucaucgagggcggguggaccggcaugguggacgggugguacggcuaccaccaccagaacgagcagggcagcggguacgccgcggaccagaaguccacccagaacgccaucaacggcaucaccaacaaggucaacagcgugaucgagaagaugaacacccaguucacggccguggggaaggaguucaacaagcuggagcggcgcauggagaaccugaacaagaaggucgacgacggcuucaucgacaucuggaccuacaacgccgagcuccuggugcugcucgagaacgagcggacccuggacuuccacgacuccaacgucaagaaccuguacgagaaggucaagucgcagcucaagaacaacgccaaggagaucgggaacggcugcuucgaguucuaccacaagugcaacgacgagugcauggaguccgugaagaacggcaccuacgacuaccccaaguacagcgaggaguccaagcugaaccgcgagaagaucgacggggugaagcuggagucgaugggcguguaccagauccucgcgaucuacuccacgguggccagcucgcugguccugcucgugucccugggggccaucagcuucuggaugugcuccaacggcagccugcagugccggaucugcaucuga

SEQ ID NO: 4198 - RNA, 1701 nt, Artificial Sequence
  derived and/or modified CDS sequence (AUadapt) from InfluenzaA__ADA71172__HA
augaagaccaucaucgcccugucguacauccucugccugguguucacccagaagcugcccggcaacgacaacuccacggccacccucugccuggggcaccacgcggucccgaacggcaccaucgugaagaccaucacgaacgaccagaucgaggugaccaacgccaccgagcugguccagucguccagcaccggggagaucugcgacucgccccaccagauccucgacggcgagaacugcacgcugaucgacgcccugcucggggacccccagugcgacggcuuccagaacaagaagugggaccuguucguggagcgcagcaaggccuacuccaacugcuaccccuacgacgugccggacuacgccucgcugcggucccucgucgcgagcuccggcacccuggaguucaacaacgagucguucaacuggaccggggugacccagaacggcacguccucggccugcauccgccgguccaacaacagcuucuucucccgccugaacuggcucacccaccugaaguucaaguaccccgcccugaacgugaccaugcccaacaacgagcaguucgacaagcucuacaucuggggcguccaccaccccgggaccgacaacgaccagaucuuccuguacgcccaggcgucggggcggaucacgguguccaccaagcgcagccagcagaccgugaucccgaacaucggcucgcggccccgcguccggaacauccccucccgcaucagcaucuacuggaccaucgugaagcccggcgacauccugcucaucaacuccacggggaaccugaucgccccgcggggcuacuucaagauccgcucggggaaguccucgaucaugcgguccgacgcccccaucggcaagugcaacagcgagugcaucacccccaacggcuccauccccaacgacaagccguuccagaacgugaaccgcaucaccuacggggccugcccccgguacgucaagcagaacacccugaagcucgccacgggcaugcgcaacgugcccgagaagcagacccgggggaucuucggcgcgaucgccggguucaucgagaacggcugggagggcaugguggacgggugguacggcuuccgccaccagaacucggaggggcggggccaggccgccgaccugaaguccacccaggccgcgaucgaccagaucaacgggaagcugaaccgccucaucggcaagaccaacgagaaguuccaccagaucgagaaggaguucagcgaggucgagggccggauccaggaccuggagaaguacguggaggacacgaagaucgaccugugguccuacaacgccgagcuccugguggcccuggagaaccagcacaccaucgaccucaccgacucggagaugaacaagcuguucgagaagaccaagaagcagcugcgcgagaacgccgaggacauggggaacggcugcuucaagaucuaccacaagugcgacaacgccugcaucggguccauccgcaacggcacguacgaccacgacgucuaccgggacgaggcgcucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 4199 - RNA, 1698 nt, Artificial Sequence
  derived and/or modified CDS sequence (AUadapt) from InfluenzaA__ADA71176__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucucgaaggaguccuggagcuacaucguggagaagcccaaccccgagaacgggaccugcuaccccggccacuucgccgacuacgaggagcugcgcgagcagcucuccagcguguccucguucgagcgguucgagaucuucccgaaggaguccagcuggcccaaccacacggucaccggggccuccgccagcugcucccacaacggcgagaacucguucuaccgcaaccugcuguggcucaccgggaagaacggccuguaccccaaccuguccaagagcuacgccaacaacaaggagaaggaggugcucgugcuguggggcguccaccacccgcccaacaucgccaaccagaagacccuguaccacacggagaacgccuacguguccguggucagcucgcacuacucccggaaguucacccccgagaucgcgaagcgccccaaggugcgggaccaggagggccgcaucaacuacuacuggacccuccuggagcccggcgacaccaucaucuucgaggccaacgggaaccugaucgccccgcgguacgccuucgcccucagccgcggcuucggguccggcaucaucaacucgaacgcgcccauggacaagugcgacgccacgugccagacgccccagggcgccaucaacuccagccugcccuuccagaacgugcacccggucaccaucggggagugccccaaguacgugcgguccgccaagcugcgcauggugaccggccuccggaacauccccagcauccagucccgcgggcuguucggcgccaucgcgggguucaucgagggcggcuggaccgggauggucgacggcugguacggguaccaccaccagaacgagcagggcucgggguacgccgccgaccagaaguccacccagaacgccaucaacggcaucaccaacaaggugaacagcgugaucgagaagaugaacacccaguucacggccgucggcaaggaguucaacaagcuggagcggcgcauggagaaccucaacaagaagguggacgacggguucaucgacaucuggaccuacaacgcggagcugcugguccuccuggagaacgagcggacccuggacuuccacgacuccaacgugaagaaccucuacgagaaggucaagagccagcugaagaacaacgccaaggagaucggcaacgggugcuucgaguucuaccacaagugcaacgacgagugcauggaguccgugaagaacggcaccuacgacuaccccaaguacucggaggaguccaagcugaaccgcgagaagaucgacggggugaagcucgagagcaugggcguguaccagauccuggccaucuacuccacggucgccagcucgcuggugcuccuggugucccugggcgccaucagcuucuggaugugcuccaacgggagccuccagugccggaucugcaucuga

SEQ ID NO: 4200 - RNA, 1701 nt, Artificial Sequence; identical to SEQ ID NO: 4015
  derived and/or modified CDS sequence (AUadapt) from InfluenzaA__ADA71181__HA

SEQ ID NO: 4201 - RNA, 1701 nt, Artificial Sequence; identical to SEQ ID NO: 4015
  derived and/or modified CDS sequence (AUadapt) from InfluenzaA__ADA71191__HA

SEQ ID NO: 4202 - RNA, 1701 nt, Artificial Sequence
  derived and/or modified CDS sequence (AUadapt) from InfluenzaA__ADA79587__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgaacagcugguccuacaucguggagaccucguccagcgacaacggcacgugcuaccccggcgacuucaucgacuacgaggagcuccgggagcagcuguccucgguguccagcuucgagcgcuucgagaucuuccccaagaccuccucguggcccaaccacgacuccaacaagggggucaccgccgccugcccgcacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacguguucgugggcacgucgcgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccucgcugcccuuccagaacauccaccccaucaccaucgggaagugccccaaguacgugaaguccaccaagcugcggcucgcgaccggccugcgcaacaucccgagcauccagucccgggggcuguucggcgccaucgccggguucaucgagggcggcuggacggggauggucgacggcugguacggguaccaccaccagaacgagcagggcucgggguacgccgccgaccucaaguccacccagaacgcgaucgacgagaucaccaacaaggugaacagcgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcucgcagcugaagaacaacgccaaggagaucgggaacggcugcuucgaguucuaccacaagugcgacaacacgugcauggaguccgucaagaacgggaccuacgacuaccccaaguacagcgaggaggccaagcugaaccgggaggagaucgacggcgugaagcucgaguccacccgcaucuaccagauccuggcgaucuacucgaccguggccuccagccugguccucguggugucgcugggggccaucuccuucuggaugugcagcaacggcucccugcagugccggaucugcaucuga

SEQ ID NO: 4203 - RNA, 1701 nt, Artificial Sequence
  derived and/or modified CDS sequence (AUadapt) from InfluenzaA__ADA79607__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaagggguucuacaagaaccugaucuggcucgugaagaagggcaacuccuaccccaagcugucgaaguccuacaucaacgacaaggggaaggaggugcugguccucuggggcauccaccaccccagcaccucggccgaccagcagucccuguaccagaacgccgacgccuacguguucgugggcacgucgcgguacuccaagaaguucaagcccgagaucgccauccgcccgaagguccgggaccaggaggggcgcaugaacuacuacuggacccugguggagcccggcgacaagaucaccuucgaggcgaccgggaaccucguggucccccgguacgccuucgccauggagcgcaacgccggcagcggcaucaucaucuccgacacgcccgugcacgacugcaacacgaccugccagaccccgaagggggccaucaacaccucgcugcccuuccagaacauccaccccaucaccaucggcaagugccccaaguacgugaaguccaccaagcugcggcucgcgaccgggcugcgcaacgucccgagcauccagucccggggccuguucggggccaucgccggcuucaucgagggcggguggacgggcaugguggacgggugguacggcuaccaccaccagaacgagcaggggucgggcuacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcaucuaccagauccuggcgaucuacucgaccgucgccuccagccuggugcucguggucucgcugggcgccaucuccuucuggaugugcagcaacggcucccugcagugccggaucugcaucuga

SEQ ID NO: 4204 - RNA, 1701 nt, Artificial Sequence
  derived and/or modified CDS sequence (AUadapt) from InfluenzaA__ADA83043__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggagcgcgagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggcgaucuacuccaccgucgccucgagccuggugcucguggucucccugggggccaucucguucuggaugugcuccaacggcagccugcagugccgcaucugcaucuga

SEQ ID NO: 4205 - RNA, 1701 nt, Artificial Sequence
  derived and/or modified CDS sequence (AUadapt) from InfluenzaA__ADA83044__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccaacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggagaacucguaccccaagcugaacaaguccuacaucaacgacaaggggaaggaggugcugguccucuggggcauccaccaccccagcaccucggccgaccagcagucccuguaccagaacgccgacgccuacguguucguggggacgucgcgguacuccaagaaguucaagcccgagaucgccauccgcccgaagguccggggccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccucgcugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcucgggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccgacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 4206 - RNA, 1701 nt, Artificial Sequence; identical to SEQ ID NO: 116
  derived and/or modified CDS sequence (AUadapt) from InfluenzaA__ADA83580__HA

SEQ ID NO: 4207 - RNA, 1701 nt, Artificial Sequence; identical to SEQ ID NO: 116
  derived and/or modified CDS sequence (AUadapt) from InfluenzaA__ADA83587__HA

SEQ ID NO: 4208 - RNA, 1701 nt, Artificial Sequence
  derived and/or modified CDS sequence (AUadapt) from InfluenzaA__ADA83591__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucuccauccgcccgaagguccgggaccaggagggccgcaugaacuacuacuggacccugguggagcccggggacaagaucaccuucgaggccaccggcaaccucguggucccccgguacgcguucgccauggagcgcaacgccgggucgggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgccaccggccugcgcaacgucccgucgauccagucccgggggcuguucggcgcgaucgccggguucaucgagggcggcuggacggggaugguggacggcugguacggguaccaccaccagaacgagcagggcagcggguacgccgccgaccucaaguccacccagaacgccaucgacgagaucaccaacaaggugaacucggucaucgagaagaugaacacccaguucacggcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggccaucuacagcaccgucgcgucgucccuggugcucguggucagccugggggccaucuccuucuggaugugcagcaacggcucccugcagugccggaucugcaucuga

SEQ ID NO: 4209 - RNA, 1701 nt, Artificial Sequence; identical to SEQ ID NO: 3659
  derived and/or modified CDS sequence (AUadapt) from InfluenzaA__ADA83595__HA

SEQ ID NO: 4210 - RNA, 1701 nt, Artificial Sequence; identical to SEQ ID NO: 116
  derived and/or modified CDS sequence (AUadapt) from InfluenzaA__ADA83599__HA

SEQ ID NO: 4211 - RNA, 1701 nt, Artificial Sequence; identical to SEQ ID NO: 116
  derived and/or modified CDS sequence (AUadapt) from InfluenzaA__ADA83603__HA

SEQ ID NO: 4212 - RNA, 1701 nt, Artificial Sequence; identical to SEQ ID NO: 116
  derived and/or modified CDS sequence (AUadapt) from InfluenzaA__ADA83611__HA

SEQ ID NO: 4213 - RNA, 1701 nt, Artificial Sequence
  derived and/or modified CDS sequence (AUadapt) from InfluenzaA__ADA83615__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgaccucaacgugaagaaccuguacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcucaaccgggaggagaucgacggcgugaagcuggaguccacccgcaucuaccagauccuggcgaucuacucgaccgucgccuccagccucgugcugguggucucgcugggggccaucuccuucuggaugugcagcaacggcucccuccagugccggaucugcaucuga

SEQ ID NO: 4214 - RNA, 1701 nt, Artificial Sequence
  derived and/or modified CDS sequence (AUadapt) from InfluenzaA__ADA83622__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagcggcuguaccagaacgccgacgccuacguguucgugggcacgucgcgcuacuccaagaagcugaagcccgagaucgccauccggccgaagguccgcgaccaggagggccggaugaacuacuacuggacccucguggagcccggggacaagaucaccuucgaggcgaccggcaaccugguggucccccgcuacgccuucgccauggagcggaacgccgggucgggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcuccgccuggcgaccggccugcggaacgucccgucgauccagucccgcggccucuucggggccaucgccggguucaucgagggcggcuggacggggaugguggacggcugguacggguaccaccaccagaacgagcagggcagcggguacgccgccgaccugaaguccacccagaacgcgaucgacgagaucaccaacaaggugaacucggucaucgagaagaugaacacccaguucacggccgugggcaaggaguucaaccaccuggagaagcggaucgagaaccucaacaagaaggucgacgacggcuuccuggacaucuggaccuacaacgccgagcugcucgugcugcuggagaacgagcgcacccucgacuaccacgacuccaacgugaagaaccuguacgagaagguccggucgcagcugaagaacaacgccaaggagaucgggaacggcugcuucgaguucuaccacaagugcgacaacacgugcauggaguccgugaagaacgggaccuacgacuaccccaaguacagcgaggaggccaagcucaaccgcgaggagaucgacggcgugaagcuggaguccacccggaucuaccagauccuggcgaucuacucgaccgucgccuccagccucgugcugguggucucgcugggggccaucuccuucuggaugugcagcaacggcucccuccagugccgcaucugcaucuga

SEQ ID NO: 4215 - RNA, 1701 nt, Artificial Sequence; identical to SEQ ID NO: 116
  derived and/or modified CDS sequence (AUadapt) from InfluenzaA__ADA83633__HA

SEQ ID NO: 4216 - RNA, 1701 nt, Artificial Sequence; identical to SEQ ID NO: 116
  derived and/or modified CDS sequence (AUadapt) from InfluenzaA__ADA83637__HA

SEQ ID NO: 4217 - RNA, 1701 nt, Artificial Sequence; identical to SEQ ID NO: 116
  derived and/or modified CDS sequence (AUadapt) from InfluenzaA__ADA83641__HA

SEQ ID NO: 4218 - RNA, 1701 nt, Artificial Sequence; identical to SEQ ID NO: 116
  derived and/or modified CDS sequence (AUadapt) from InfluenzaA__ADA83645__HA

SEQ ID NO: 4219 - RNA, 1701 nt, Artificial Sequence; identical to SEQ ID NO: 116
  derived and/or modified CDS sequence (AUadapt) from InfluenzaA__ADA83648__HA

SEQ ID NO: 4220 - RNA, 1701 nt, Artificial Sequence; identical to SEQ ID NO: 116
  derived and/or modified CDS sequence (AUadapt) from InfluenzaA__ADA83656__HA

SEQ ID NO: 4221 - RNA, 1701 nt, Artificial Sequence; identical to SEQ ID NO: 116
  derived and/or modified CDS sequence (AUadapt) from InfluenzaA__ADA83660__HA

SEQ ID NO: 4222 - RNA, 1701 nt, Artificial Sequence
  derived and/or modified CDS sequence (AUadapt) from InfluenzaA__ADA83664__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaccgccauccgcccgaagguccgggaccaggagggccgcaugaacuacuacuggacccugguggagcccggggacaagaucaccuucgaggcgacgggcaaccucguggucccccgguacgccuucgccauggagcgcaacgccggguccggcaucaucaucucggacacccccgugcacgacugcaacacgaccugccagaccccgaagggcgccaucaacaccucccugcccuuccagaacauccaccccaucaccaucgggaagugccccaaguacgucaagagcaccaagcugcggcucgcgacgggccugcgcaacgugccguccauccagucgcgggggcuguucggcgccaucgccggguucaucgagggcggcuggaccgggaugguggacggcugguacggguaccaccaccagaacgagcagggcuccggguacgccgccgaccucaagucgacccagaacgcgaucgacgagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 4223 - RNA, 1701 nt, Artificial Sequence
  derived and/or modified CDS sequence (AUadapt) from InfluenzaA__ADA83668__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcggcucgcuguccaccgccagcuccuggucguacaucguggagaccuccagcuccgacaacggcacgugcuaccccggggacuucaucgacuacgaggagcuccgggagcagcugucguccgugagcuccuucgagcgcuucgagaucuuccccaagaccucguccuggcccaaccacgacagcaacaagggcgucaccgccgccugcccgcacgccggggcgaaguccuucuacaagaaccugaucuggcucgugaagaagggcaacucguaccccaagcuguccaagagcuacaucaacgacaaggggaaggaggugcugguccucuggggcauccaccaccccucgaccuccgccgaccagcagagccuguaccagaacgccgacgccuacguguucgugggcacgucccgguacucgaagaaguucaagcccgagaucgccauccgcccgaagguccgggaccaggaggggcgcaugaacuacuacuggacccugguggagcccggcgacaagaucaccuucgaggcgaccgggaaccucguggucccccgguacgccuucgccauggagcgcaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagucgaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcucgagagcacccgcaucuaccagauccuggcgaucuacuccaccgucgccucgagccuggugcucguggucucccugggcgccaucucguucuggaugugcuccaacggcagccugcagugccggaucugcaucuga

SEQ ID NO: 4224 - RNA, 1701 nt, Artificial Sequence; identical to SEQ ID NO: 116
  derived and/or modified CDS sequence (AUadapt) from InfluenzaA__ADA83672__HA

SEQ ID NO: 4225 - RNA, 1701 nt, Artificial Sequence; identical to SEQ ID NO: 116
  derived and/or modified CDS sequence (AUadapt) from InfluenzaA__ADA83676__HA

SEQ ID NO: 4226 - RNA, 1701 nt, Artificial Sequence; identical to SEQ ID NO: 116
  derived and/or modified CDS sequence (AUadapt) from InfluenzaA__ADA83680__HA

SEQ ID NO: 4227 - RNA, 1701 nt, Artificial Sequence
  derived and/or modified CDS sequence (AUadapt) from InfluenzaA__ADA86068__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccguggaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccggaaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaucaagcugcggcucgcgaccggccugcgcaacgugccguccauccagucgcgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgacccgcaucuaccagauccuggcgaucuacuccaccgucgccagcucgcuggugcucguggucucccugggggccaucagcuucuggaugugcuccaacggcagccugcagugccggaucugcaucuga

SEQ ID NO: 4228 - RNA, 1701 nt, Artificial Sequence
  derived and/or modified CDS sequence (AUadapt) from InfluenzaA__ADA86086__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccaacgccgaccagcagucccuguaccagaacgccgacgccuacguguucgugggcacgucgcgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccucgcugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcucgggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 4229 - RNA, 1701 nt, Artificial Sequence
  derived and/or modified CDS sequence (AUadapt) from InfluenzaA__ADA86087__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgucguccuggagcuacaucguggagaccuucuccucggacaacggcacgugcuaccccggcgacuucaucgacuacgaggagcuccgggagcagcuguccagcguguccucguucgagcgcuucgagaucuuccccaagaccuccagcuggcccaaccacgacuccaacaagggggucaccgccgccugcccgcacgccggcgccaagucguucuacaagaaccugaucuggcucgugaagaaggggaacuccuaccccaagcugagcaaguccuacaucaacgacaagggcaaggaggugcugguccucugggggauccaccaccccucgaccagcgccgaccagcagucccuguaccagaacgccgacgccuacguguucgugggcacgucgcgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgcccugaacaccucgcugcccuuccagaacauccaccccaucaccaucgggaagugccccaaguacgugaaguccaccaagcuccggcuggcgaccggccugcgcaacgucccgagcauccagucccggggccucuucggggccaucgccggguucaucgagggcggcuggacggggaugguggacggcugguacggguaccaccaccagaacgagcagggcucgggguacgccgccgaccugaaguccacccagaacgcgaucgacgagaucaccaacaaggugaacagcgucaucgagaagaugaacacccaguucacggccgugggcaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacuccaacgugaagaaccuguacgagaagguccgcaaccagcugaagaacaacgccaaggagaucgggaacggcugcuucgaguucuaccacaagugcgacaacacgugcauggagucggugaagaacgggaccuacgacuaccccaaguacuccgaggaggccaagcucaaccgggaggagaucgacggcgugaagcuggagagcacccgcaucuaccagauccuggcgaucuacuccaccgucgccucgucccucgugcugguggucagccugggggccaucucguucuggaugugcuccaacggcagccuccagugccggaucugcaucuga

SEQ ID NO: 4230 - RNA, 1701 nt, Artificial Sequence; identical to SEQ ID NO: 3712
  derived and/or modified CDS sequence (AUadapt) from InfluenzaA__ADA86088__HA

SEQ ID NO: 4231 - RNA, 1701 nt, Artificial Sequence
  derived and/or modified CDS sequence (AUadapt) from InfluenzaA__ADB03603__HA
augaaggccauccugaucgugcuccuguacaccuucgccaccgcgcacgccgacacgcugugcaucggcuaccacgccaacaacucgaccgacaccgucgacaccgugcucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagucgcuguccaccgccagcuccuggucguacaucgucgagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggugaccgccgccugcccgcacgccggcgcgaaguccuucuacaagaaccugaucuggcucgucaagaaggggaacucguaccccaagcuguccaagagcuacaucaacgacaagggcaaggaggugcuggugcucugggggauccaccaccccucgaccuccgccgaccagcagagccuguaccagaacgccgacgccuacgucuucgugggcacgucccgguacucgaagaaguucaagcccgagaucgccauccgcccgaaggugcgggaccaggagggccgcauggacuacuacuggacccuggucgagcccggggacaagaucaccuucgaggcgaccggcaaccucguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgagccugguccucguggugucccugggggccaucucguucuggaugugcuccaacggcagccugcagugccggaucugcaucuga

SEQ ID NO: 4232 - RNA, 1701 nt, Artificial Sequence; identical to SEQ ID NO: 62
  derived and/or modified CDS sequence (AUadapt) from InfluenzaA__ADB03604__HA

SEQ ID NO: 4233 - RNA, 1701 nt, Artificial Sequence
  derived and/or modified CDS sequence (AUadapt) from InfluenzaA__ADB03605__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggagcaggagggccgcauggacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 4234 - RNA, 1701 nt, Artificial Sequence; identical to SEQ ID NO: 116
  derived and/or modified CDS sequence (AUadapt) from InfluenzaA__ADB03607__HA

SEQ ID NO: 4235 - RNA, 1701 nt, Artificial Sequence; identical to SEQ ID NO: 3267
  derived and/or modified CDS sequence (AUadapt) from InfluenzaA__ADB03609__HA

SEQ ID NO: 4236 - RNA, 1701 nt, Artificial Sequence; identical to SEQ ID NO: 116
  derived and/or modified CDS sequence (AUadapt) from InfluenzaA__ADB03611__HA

SEQ ID NO: 4237 - RNA, 1701 nt, Artificial Sequence
  derived and/or modified CDS sequence (AUadapt) from InfluenzaA__ADB03612__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguucauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacucggucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggcgaucuacagcaccgucgccuccucgcuggugcucguggucagccugggggccaucuccuucuggaugugcagcaacggcucccugcagugccggaucugcaucuga

SEQ ID NO: 4238 - RNA, 1701 nt, Artificial Sequence; identical to SEQ ID NO: 116
  derived and/or modified CDS sequence (AUadapt) from InfluenzaA__ADB03614__HA

SEQ ID NO: 4239 - RNA, 1701 nt, Artificial Sequence
  derived and/or modified CDS sequence (AUadapt) from InfluenzaA__ADB03617__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccaaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 4240 - RNA, 1701 nt, Artificial Sequence; identical to SEQ ID NO: 3267
  derived and/or modified CDS sequence (AUadapt) from InfluenzaA__ADB03619__HA

SEQ ID NO: 4241 - RNA, 1701 nt, Artificial Sequence
  derived and/or modified CDS sequence (AUadapt) from InfluenzaA__ADB03620__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggggaagcacaacggcaagcucugcaagcugcgcggggucgcgccccugcaccucggcaagugcaacaucgccggguggauccugggcaacccggagugcgagucgcuguccaccgccagcuccuggucguacaucguggagaccuccagcuccgacaacggcacgugcuaccccggggacuucaucgacuacgaggagcuccgggagcagcugucguccgugagcuccuucgagcgcuucgagaucguccccaagaccucguccuggcccaaccacgacucgaacaagggcgugaccgccgccugcccgcacgccggggcgaaguccuucuacaagaaccugaucuggcucgugaagaagggcaacagcuaccccaagcuguccaagucguacaucaacgacaaggggaaggagguccuggugcucuggggcauccaccaccccagcaccuccgccgaccagcagucgcuguaccagaacgccgacgccuacguguucgucggcacgucccgguacagcaagaaguucaagcccgagaucgccauccgcccgaaggugcgggaccaggaggggcgcaugaacuacuacuggacccugguggagcccggcgacaagaucaccuucgaggcgaccgggaaccucgucgugccccgguacgccuucgccauggagcgcaacgccggcuccggcaucaucaucucggacacgcccgugcacgacugcaacacgaccugccagaccccgaagggggccaucaacaccucccugcccuuccagaacauccaccccaucaccaucggcaagugccccaaguacgucaagagcaccaagcugcggcucgcgaccgggcugcgcaacgugccguccauccagucgcggggccuguucggggccaucgccggcuucaucgagggcggguggacgggcaugguggacgggugguacggcuaccaccaccagaacgagcagggguccggcuacgccgccgaccucaagucgacccagaacgcgaucgacgagaucaccaacaaggucaacuccgugaucgagaagaugaacacccaguucacggccgucggcaaggaguucaaccaccuggagaagcgcaucgagaaccugaacaagaagguggacgacggguuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggucaagcucgagagcacccgcaucuaccagauccuggcgaucuacuccaccguggccucgagccuggugcucgucgugucccugggcgccaucucguucuggaugugcuccaacggcagccugcagugccggaucugcaucuga

SEQ ID NO: 4242 - RNA, 1701 nt, Artificial Sequence
  derived and/or modified CDS sequence (AUadapt) from InfluenzaA__ADB03622__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaacggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 4243 - RNA, 1701 nt, Artificial Sequence; identical to SEQ ID NO: 4242
  derived and/or modified CDS sequence (AUadapt) from InfluenzaA__ADB03623__HA

SEQ ID NO: 4244 - RNA, 1701 nt, Artificial Sequence
  derived and/or modified CDS sequence (AUadapt) from InfluenzaA__ADB03628__HA
auggaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccacaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 4245 - RNA, 1701 nt, Artificial Sequence
  derived and/or modified CDS sequence (AUadapt) from InfluenzaA__ADB03629__HA
augaaggccauccuggugguccuccuguacaccuucaccacggccaacgcggacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagacguccucguccgacaacgggaccugcuaccccggcgacuucaucgacuacgaggagcuccgggagcagcugagcuccgugucguccuucgagcgcuucgagaucuuccccaagaccagcuccuggcccaaccacgacagcaacaagggcgucaccgccgccugcccgcacgccggcgccaaguccuucuacaagaaccugaucuggcucgugaagaaggggaacucguaccccaagcuguccaagagcuacaucaacgacaagggcaaggaggugcugguccucugggggauccaccaccccucgacguccgcggaccagcagagccuguaccagaacgccgacgccuacguguucgugggcaccucccgguacucgaagaaguucaagcccgagaucgccauccgcccgaagguccgggagcaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccacucgaucaccaucgggaagugccccaaguacgugaaguccaccaagcugcggcucgccacgggccugcgcaacguccccagcauccagucccgggggcuguucggcgcgaucgccggguucaucgagggcggcuggaccgggaugguggacggcugguacggguuccaccaccagaacgagcagggcagcggguacgccgccgaccucaaguccacccagaacgccaucgacgagaucaccaacaaggugaacucggucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuacccgaaguacucggaggaggccaagcugaaccgggaggagaucgacggcgugaagcucgaguccacccgcaucuaccagauccuggccaucuacagcaccgucgcgucgucccuggugcucguggucagccugggggccaucuccuucuggaugugcagcaacggcucccugcagugccggaucugcaucuga

SEQ ID NO: 4246 - RNA, 1701 nt, Artificial Sequence
  derived and/or modified CDS sequence (AUadapt) from InfluenzaA__ADB03630__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuaccacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccaaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 4247 - RNA, 1701 nt, Artificial Sequence; identical to SEQ ID NO: 3659
  derived and/or modified CDS sequence (AUadapt) from InfluenzaA__ADB25319__HA

SEQ ID NO: 4248 - RNA, 1701 nt, Artificial Sequence; identical to SEQ ID NO: 116
  derived and/or modified CDS sequence (AUadapt) from InfluenzaA__ADB25321__HA

SEQ ID NO: 4249 - RNA, 1701 nt, Artificial Sequence
  derived and/or modified CDS sequence (AUadapt) from InfluenzaA__ADB27970__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcgacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 4250 - RNA, 1701 nt, Artificial Sequence; identical to SEQ ID NO: 116
  derived and/or modified CDS sequence (AUadapt) from InfluenzaA__ADB27980__HA

SEQ ID NO: 4251 - RNA, 1701 nt, Artificial Sequence; identical to SEQ ID NO: 116
  derived and/or modified CDS sequence (AUadapt) from InfluenzaA__ADB54352__HA

SEQ ID NO: 4252 - RNA, 1701 nt, Artificial Sequence; identical to SEQ ID NO: 116
  derived and/or modified CDS sequence (AUadapt) from InfluenzaA__ADB54355__HA

SEQ ID NO: 4253 - RNA, 1698 nt, Artificial Sequence
  derived and/or modified CDS sequence (AUadapt) from InfluenzaA__ADB65926__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacaagcacaacgggaagcucugccugcugaagggcaaggcgccccuccagcuggggaacugcagcgucgccggcuggauccuggggaacccggagugcggccuccugaucuccaaggagagcugguccuacaucguggagcgccccaaccccgagaacgggaccugcuaccccggccacuucgccgacuacgaggagcugcgggagcagcucucguccgugagcuccuucgagcgcuucgagaucuucccgaagggcagcuccuggcccaaccacacggucaccggggugucggccuccugcagccacaacggcgaguccagcuucuacaagaaccugcuguggcucaccgggaagaacggccuguaccccaaccuguccaagucguacgccaacaacaaggagaaggaggugcucguccuguggggcgugcaccacccgcccaacaucggggaccagaugacccuguaccacaaggagaacgccuacguguccgucgugagcagccacuacucccggaaguucacgcccgagaucgccaagcgccccaaggugcgggaccaggagggccgcaucaacuacuacuggacccuccuggagcccggggacaccaucaucuucgaggccaacggcaaccugaucgcgccgcgguacgccuucgcccucucgcgcggcuucggguccggcaucaucaacagcaacgcccccauggacgagugcgacgccaagugccagacgccccagggggcgaucaacuccagccugcccuuccagaacguccacccggugaccaucggcgagugccccaaguacgugcgguccgccaagcugcgcauggucaccgggcuccggaacauccccucgauccagucccgcggccuguucggcgccaucgccggguucaucgagggcggguggaccggcaugguggacgggugguacggcuaccaccaccagaacgagcagggcagcggguacgccgcggaccagaaguccacccagaacgccaucaacggcaucacgaacaaggugaacagcgucaucgagaagaugaacacccaguucaccgccguggggaaggaguucaacaagcuggagcggcgcauggagaaccucaacaagaaggucgacgacggcuucaucgacguguggaccuacaacgccgagcugcuggugcuccuggagaacgagcggacgcuggacuuccacgacuccaacgucaagaaccucuacgagaaggugaagaaccagcugaagaacaacgccaaggagauggggaacggcugcuucgaguucuaccacaagugcaacgacgagugcauggagucggugaagaacggcaccuacgacuaccccaaguacuccgaggagagcaagcugucccgcgagaagaucgacggggucaagcucgagagcaugggcguguaccagauccuggcgaucuacuccaccguggccucgagccugguccuccuggugucccugggggccaucggcuucuggaugugcagcaacggcucccuccagugccggaucugcaucuga

SEQ ID NO: 4254 - RNA, 1698 nt, Artificial Sequence
  derived and/or modified CDS sequence (AUadapt) from InfluenzaA__ADB80153__HA
augaaggugaagcugcucgcccugcugugcaccuucaccgccacguacgcggacaccaucugcaucggcuaccacgccaacaacucgaccgacaccgucgacacggugcucgagaagaacgugaccgucacccacuccgugaaccugcuggaggacaaccacaacgggaagcucugccugcugaagggcaucgcgccccuccagcuggggaacugcagcguggccggcuggauccuggggaacccggagugcgagcuccugaucuccaaggagagcugguccuacaucgucgagaagcccaaccccgagaacgggaccugcuaccccggccacuucgccgacuacgaggagcugcgcgagcagcucucguccgugagcuccuucgagcgguucgagaucuucccgaaggagagcuccuggcccaaccacacggugaccggggucagcgccuccugcucgcacaacggcgaguccagcuucuacaagaaccugcuguggcucaccgggaagaacggccuguaccccaaccuguccaagagcuucgccaacaacaaggagaaggaggugcucgugcuguggggcguccaccacccgcccaacaucggcgaccagaugacccuguaccacaaggagaacgccuacguguccguggucucgagccacuacucccgcaaguucacgcccgagaucgccaagcggcccaaggugcgcgaccaggagggccggaucaacuacuacuggacccuccuggagcccggggacaccaucaucuucgaggcgaacggcaaccugaucgccccgcgcuacgccuucgcccucagccggggguucggcuccggcaucaucaacagcaacgcccccauggacgagugcgacgcgaagugccagacgccccagggggccaucaacuccucgcugcccuuccagaacgugcacccggucaccaucggcgagugccccaaguacgugcgcuccaccaagcugcggauggugaccgggcuccgcaacauccccagcauccagucccggggccuguucggggccaucgccggcuucaucgagggcggguggaccggcauggucgacgggugguacggcuaccaccaccagaacgagcaggggagcggcuacgccgcggaccagaaguccacgcagaacgccaucaacggcaucaccaacaaggugaacucggugaucgagaagaugaacacccaguucaccgccgucgggaaggaguucaacaagcuggagcgccggauggagaaccucaacaagaagguggacgacggcuucaucgacgucuggacguacaacgccgagcugcuggugcuccuggagaacgagcgcacccuggacuuccacgacuccaacgugaagaaccucuacgagaaggucaagaaccagcugaagaacaacgccaaggagaucgggaacggcugcuucgaguucuaccacaagugcaacgacgagugcauggagagcgugaagaacgggaccuacgacuaccccaaguacuccgaggagagcaagcugucccgggagaagaucgacggcgugaagcucgagagcaugggcgucuaccagauccuggcgaucuacuccaccguggccucgagccuggugcuccuggucucccugggggccaucagcuucuggaugugcuccaacggcagccuccagugccgcaucugcaucuga

SEQ ID NO: 4255 - RNA, 1701 nt, Artificial Sequence; identical to SEQ ID NO: 4015
  derived and/or modified CDS sequence (AUadapt) from InfluenzaA__ADB81399__HA

SEQ ID NO: 4256 - RNA, 1701 nt, Artificial Sequence; identical to SEQ ID NO: 4015
  derived and/or modified CDS sequence (AUadapt) from InfluenzaA__ADB81409__HA

SEQ ID NO: 4257 - RNA, 1701 nt, Artificial Sequence
  derived and/or modified CDS sequence (AUadapt) from InfluenzaA__ADB81419__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacaucccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccgaguacuccgaggaggccaagcugaaccgggaggagaucgacggcgugaagcucgagagcacccgcaucuaccagauccuggcgaucuacuccaccguggccucgagccugguccucguggugucccugggggccaucucguucuggaugugcuccaacggcagccugcagugccggaucugcaucuga

SEQ ID NO: 4258 - RNA, 1701 nt, Artificial Sequence; identical to SEQ ID NO: 4074
  derived and/or modified CDS sequence (AUadapt) from InfluenzaA__ADB81429__HA

SEQ ID NO: 4259 - RNA, 1701 nt, Artificial Sequence
  derived and/or modified CDS sequence (AUadapt) from InfluenzaA__ADB81439__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacccgaacaagggggucaccgccgccugcccccacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacguguucgugggcacgucgcgguacuccaagaaguucaagccggagaucgccauccgccccaagguccggaaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgccggugcacgacugcaacacgaccugccagacccccaagggcgccaucaacaccucgcugcccuuccagaacauccaccccaucaccaucgggaagugcccgaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcucgggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 4260 - RNA, 1701 nt, Artificial Sequence
  derived and/or modified CDS sequence (AUadapt) from InfluenzaA__ADB81449__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcugaacaaguccuacaucaacgacaagggcaaggaggugcugguccucugggggauccaccaccccagcaccucggccgaccagcagucccuguaccagaacgccgacgccuacguguucgugggcacgucgcgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccucgcugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcucgggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 4261 - RNA, 1701 nt, Artificial Sequence
  derived and/or modified CDS sequence (AUadapt) from InfluenzaA__ADB81459__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcugaacaaguccuacaucaacgacaagggcaaggaggugcugguccucugggggauccaccaccccagcaccucggccgaccagcagucccuguaccagaacgccgacgccuacguguucgugggcacgucgcgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgggggcagcggcaucaucaucuccgacacgcccgugcacgacugcaacacgaccugccagaccccgaagggggccaucaacaccucgcugcccuuccagaacauccaccccaucaccaucggcaagugccccaaguacgugaaguccaccaagcugcggcucgccaccgggcugcgcaacgucccgagcauccagucccggggccuguucggggcgaucgccggcuucaucgagggcggguggacgggcaugguggacgggugguacggcuaccaccaccagaacgagcaggggucgggcuacgccgccgaccucaaguccacccagaacgccaucgacgagaucaccaacaaggugaacagcgucaucgagaagaugaacacccaguucacggcggugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcaucuaccagauccuggccaucuacucgaccgucgcguccagccuggugcucguggucucgcugggcgccaucuccuucuggaugugcagcaacggcucccugcagugccggaucugcaucuga

SEQ ID NO: 4262 - RNA, 1701 nt, Artificial Sequence
  derived and/or modified CDS sequence (AUadapt) from InfluenzaA__ADB82655__HA
augaaggccauccugcucgugcugcugugcacccucgccgcggccaacgccgacacccugugcaucggcuaccacgccaacaacucgacggacaccgucgacaccgugcuggagaagaacgugaccgucacgcacuccgugaaccuccuggaggaccgccacaacgggaagcugugcaaccuccggggcaaggcgccccugcaccuggggaagugcaacaucgccggcuggcuccuggggaacccggagugcgagcuccuguucgccgugaacucgugguccuacaucgucgagaccucgaacuccgacaacgggaccugcuaccccggcgacuucaccucguacgaggagcugcgcgagcagcuguccagcguguccucguucgagcgguucgagaucuuccccaaggccuccucguggcccaaccacgagacgaaccgcggcgugaccgccgcgugcccguacgccggcaccaacggguucuaccggaaccucaucuggcuggucaagaaggagaacuccuaccccaagcugcgcaagucguacgugaacaacaagaagaaggaggugcucguccuguggggcauccaccacccgcccaccaacacggaccagcagucccuguaccagaacgccgacgccuacguguucguggggucguccaaguacagccggaaguucaagcccgagaucgccgagcgccccaagguccggggccaggcgggccgcaugaacuacuacuggacccucaucgagcccggggacaccaucaccuucgaggccacgggcaaccugguggcgccccgguacgccuucgccaugaaccgcgggccgguguccggcaucaucaccucggacgcccccguccacgacugcaacgcgaccugccagacccccaagggcgccaucaacacgucgcugcccuuccagaacauccacccgaucaccaucggggagugccccaaguacgugaaguccacccggcuccgcauggccaccggccugcggaacauccccucgauccagucccgcgggcuguucggcgccaucgccggguucaucgagggcggcuggacggggaugaucgacggcugguacggguaccaccaccagaacggccaggggucgggcuacgccgccgaccagaaguccacccagaacgccaucgaccggaucaccaacaaggugaacagcgucaucgagaagaugaacauccaguucaccgccgugggcaaggaguucaaccaccucgagcgccggaucgagaaccugaacaagaagguggacgacggguuccuggacgucuggacguacaacgcggagcuccuggugcugcucgagaacgagcgcacccuggacuuccacgacuccaacgucaagacccuguacgagaaggugaagacccagcuccggaacaacgccaaggagaucggcaacgggugcuucgaguucuaccacaagugcgacgacacgugcauggagucgaucaagaacggcaccuacaacuaccccaaguacuccgaggagucgaagcugaaccgcgaggagaucgacggggugaagcuggaguccacccgcaucuaccagauccucgccaucuacucgaccgccgcguccucgcugguccugcucgugucccugggcgccaucggcuucuggaugugcagcaacgggucccugcagugccggaucugcaucuga

SEQ ID NO: 4263 - RNA, 1701 nt, Artificial Sequence
  derived and/or modified CDS sequence (AUadapt) from InfluenzaA__ADB82656__HA
augaaggccauccugcucgugcugcagugcauccugaccgccgcgaacgccgacacccucugcaucggcuaccacgccaacaacucgacggacaccgucgacaccgugcuggagaagaacgugaccgucacgcacuccgugaaccugcucgaggaccgccacaacgggaagcugugcaagcugaagggcaucgcgccccuccaccuggggaagugcaacaucgccggcuggcugcucgggaacccggagugcgagcugcuguucaaggccaacagcugguccuacaucguggagaccucguacuccgacaacgggaccugcuaccccggcgacuucaccaacuacgaggagcuccgggagcagcugagcuccgucucguccuucgagcgcuucgagauguuccccaaggccaacagcuggcccaaccacgagacgaacaagggggugaccgccgccugcccguacgcgggcgccaacuccuucuaccggaaccugaucuggcucgugaagaaggggaacucguacccccgccuguccaagagcuacgucaacaacaagaagaaggaggugcuggugcucuggggcauccaccaccccuccaccagcaccgaccagcagucccuguaccagaacgccgacgccuacgucuucgugucguccagcacguacaacaagcgguucaagcccgagaucgggacccgcccgaaggugcgggaccagucgggccgcaugaacuacuacuggaccaucgucgagcccggcgacaccaucacguucgaggccaccgggaaccugguggcgccccgguacgccuucgccaugaagcgcgacuccggcagcgggaucaucauguccgacacccccgugcacgacugcaacaccacgugccagaccccgaagggcgccaucaacaccucgcuccccuuccagaacguccaccccgugaccaucggcgagugccccaaguacgugaaguccacgaagcugcggauggccaccgggcugcgcaacaucccgagcauccagucccggggccucuucggggcgaucgccggcuucaucgagggcggcuggaccggcaugaucgacgggugguacggcuaccaccaccagaacgagcaggggucgggcuacgccgccgaccgcaaguccacccagaacgccaucgacgggaucacgaacaaggucaacagcaucaucgagaagaugaacauccaguucaccgcggugggcaaggaguucucccaccuggagaagcggguggagaaccugaacaagaaggucgacgacggcuuccucgacguguggaccuacaacgccgagcugcugguccuccuggagaacgagcgcacccuggacuaccacgacagcaacgugaagaaccucuacgagaaggugcggucccagcugaagaacaacgccaaggagaucgggaacggcugcuucgaguucuaccacaagugcgacgacucgugcauggaguccaucaagaacgagacguacgacuacagcaaguacuccgaggagucgcgccugaaccgggagaagaucgacggggucaagcucgaguccacccagaucuaccagauccuggccaucuacagcaccguggccucgucccuggugcuccuggucagccugggcgcgaucuccuucuggaugugcagcaacgggucccuccagugccgcaucugcaucuga

SEQ ID NO: 4264 - RNA, 1701 nt, Artificial Sequence
  derived and/or modified CDS sequence (AUadapt) from InfluenzaA__ADB82944__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacccgaacaagggggucaccgccgccugcccccacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacguguucgugggcacgucgcgguacuccaagaaguucaagccggagaucgccauccgccccaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgccggugcacgacugcaacacgaccugccagacccccaagggcgccaucaacaccucgcugcccuuccagaacauccaccccaucaccaucgggaagugcccgaaguacgugaaguccaccaagcugcggcucgcgaccggccugcgcaacauccccagcauccagucccgggggcuguucggcgccaucgccggguucaucgagggcggcuggacggggauggucgacggcugguacggguaccaccaccagaacgagcagggcucgggguacgccgccgaccucaaguccacccagaacgcgaucgacgagaucaccaacaaggugaacagcgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcucgcagcugaagaacaacgccaaggagaucgggaacggcugcuucgaguucuaccacaagugcgacaacacgugcauggaguccgucaagaacgggaccuacgacuaccccaaguacagcgaggaggccaagcugaaccgggaggagaucgacggcgugaagcucgaguccacccgcaucuaccagauccuggcgaucuacucgaccguggccuccagccugguccucguggugucgcugggggccaucuccuucuggaugugcagcaacggcucccugcagugccggaucugcaucuga

SEQ ID NO: 4265 - RNA, 1701 nt, Artificial Sequence
  derived and/or modified CDS sequence (AUadapt) from InfluenzaA__ADB82950__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucgagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 4266 - RNA, 1701 nt, Artificial Sequence; identical to SEQ ID NO: 3712
  derived and/or modified CDS sequence (AUadapt) from InfluenzaA__ADB89129__HA

SEQ ID NO: 4267 - RNA, 1701 nt, Artificial Sequence; identical to SEQ ID NO: 116
  derived and/or modified CDS sequence (AUadapt) from InfluenzaA__ADB89139__HA

SEQ ID NO: 4268 - RNA, 1701 nt, Artificial Sequence
  derived and/or modified CDS sequence (AUadapt) from InfluenzaA__ADB89149__HA
augaaggccauccuggugguccuccuguacaccuucgccaccgcgaacgccuacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacagcaacaagggggucaccgccgccugcccgcacgugggcgccaaguccuucuacaagaaccugaucuggcucgugaagaaggggaacucguaccccaagcuguccaagagcuacaucaacgacaagggcaaggagguccuggugcucugggggauccaccaccccucgaccuccgcggaccagcagagccuguaccagaacgccgacgccuacguguucgucggcacgucccgguacucgaagaaguucaagcccgagaucgccauccgcccgaaggugcggggccaggaggggcgcaugaacuacuacuggacccugguggagcccggcgacaagaucaccuucgaggccaccgggaaccucgucgugccccgguacgcguucgccauggagcgcaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagucgaccaagcugcggcucgccaccgggcugcgcaacaucccguccauccagagccggggccuguucggggcgaucgccggcuucaucgagggcggguggacgggcaugguggacgggugguacggcuaccaccaccagaacgagcagggguccggcuacgccgccgaccucaagagcacccagaacgccaucgacgagaucaccaacaaggugaacuccgucaucgagaagaugaacacccaguucacggcggugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacucgaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagucgacccgcaucuaccagauccuggccaucuacuccaccgucgcgagcucgcuggugcucguggucucccugggcgccaucagcuucuggaugugcuccaacggcagccugcagugccggaucugcaucuga

SEQ ID NO: 4269 - RNA, 1701 nt, Artificial Sequence; identical to SEQ ID NO: 3267
  derived and/or modified CDS sequence (AUadapt) from InfluenzaA__ADB89150__HA

SEQ ID NO: 4270 - RNA, 1701 nt, Artificial Sequence
  derived and/or modified CDS sequence (AUadapt) from InfluenzaA__ADB89221__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagaaccuguaccagaacgccgacgccuacguguucgugggcagcucccgguacucgaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucacgaucgggaagugccccaaguacgucaagucgaccaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagucgacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 4271 - RNA, 1701 nt, Artificial Sequence; identical to SEQ ID NO: 2967
  derived and/or modified CDS sequence (AUadapt) from InfluenzaA__ADB89241__HA

SEQ ID NO: 4272 - RNA, 1701 nt, Artificial Sequence; identical to SEQ ID NO: 116
  derived and/or modified CDS sequence (AUadapt) from InfluenzaA__ADB89251__HA

SEQ ID NO: 4273 - RNA, 1701 nt, Artificial Sequence; identical to SEQ ID NO: 3361
  derived and/or modified CDS sequence (AUadapt) from InfluenzaA__ADB89261__HA

SEQ ID NO: 4274 - RNA, 1701 nt, Artificial Sequence
  derived and/or modified CDS sequence (AUadapt) from InfluenzaA__ADB89271__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcaugggguccgugaagaacggcaccuacgacuaccccaaguacucggaggaggccaagcugaaccgggaggagaucgacggggugaagcucgaguccacccgcaucuaccagauccuggcgaucuacagcaccgucgccucgucccuggugcucguggucagccugggcgccaucuccuucuggaugugcagcaacggcucccugcagugccggaucugcaucuga

SEQ ID NO: 4275 - RNA, 1701 nt, Artificial Sequence
  derived and/or modified CDS sequence (AUadapt) from InfluenzaA__ADB89281__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccacccgcccaccucggccgaccagcagucccuguaccagaacgccgacgccuacguguucgugggcacgucgcgguacuccaagaaguucaagcccgagaucgccauccgccccaagguccggggccaggaggggcgcaugaacuacuacuggacccugguggagcccggcgacaagaucaccuucgaggcgaccgggaaccucguggucccccgguacgccuucgccauggagcgcaacgccggcagcggcaucaucaucuccgacacgccggugcacgacugcaacacgaccugccagacccccaagggggccaucaacaccucgcugcccuuccagaacauccaccccaucaccaucggcaagugcccgaaguacgugaaguccaccaagcugcggcucgcgaccgggcugcgcaacguccccagcauccagucccggggccuguucggggccaucgccggcuucaucgagggcggguggacgggcaugguggacgggugguacggcuaccaccaccagaacgagcaggggucgggcuacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcaucuaccagauccuggcgaucuacucgaccgucgccuccagccuggugcucguggucucgcugggcgccaucuccuucuggaugugcagcaacggcucccugcagugccggaucugcaucuga

SEQ ID NO: 4276 - RNA, 1701 nt, Artificial Sequence; identical to SEQ ID NO: 116
  derived and/or modified CDS sequence (AUadapt) from InfluenzaA__ADB89291__HA

SEQ ID NO: 4277 - RNA, 1701 nt, Artificial Sequence; identical to SEQ ID NO: 116
  derived and/or modified CDS sequence (AUadapt) from InfluenzaA__ADB89301__HA

SEQ ID NO: 4278 - RNA, 1701 nt, Artificial Sequence; identical to SEQ ID NO: 116
  derived and/or modified CDS sequence (AUadapt) from InfluenzaA__ADB89311__HA

SEQ ID NO: 4279 - RNA, 1701 nt, Artificial Sequence
  derived and/or modified CDS sequence (AUadapt) from InfluenzaA__ADB89321__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccgagagcuacaucaacgacaagggcaaggaggugcugguccucugggggauccaccaccccucgaccuccgccgaccagcagagccuguaccagaacgccgacgccuacguguucgugggcacguccaaguacucgaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggcgaucuacuccaccgucgccucgagccuggugcucguggucucccugggggccaucucguucuggaugugcuccaacggcagccugcagugccgcaucugcaucuga

SEQ ID NO: 4280 - RNA, 1701 nt, Artificial Sequence
  derived and/or modified CDS sequence (AUadapt) from InfluenzaA__ADB89331__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagcaaguacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggucgggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgucgauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgcgaggagaucgacggcgugaagcucgaguccacccgggucuaccagauccuggcgaucuacagcaccguggccucgucccuggugcucgucgugagccugggggccaucuccuucuggaugugcagcaacggcucccugcagugccgcaucugcaucuga

SEQ ID NO: 4281 - RNA, 1701 nt, Artificial Sequence; identical to SEQ ID NO: 116
  derived and/or modified CDS sequence (AUadapt) from InfluenzaA__ADB89341__HA

SEQ ID NO: 4282 - RNA, 1701 nt, Artificial Sequence; identical to SEQ ID NO: 116
  derived and/or modified CDS sequence (AUadapt) from InfluenzaA__ADB89351__HA

SEQ ID NO: 4283 - RNA, 1701 nt, Artificial Sequence; identical to SEQ ID NO: 116
  derived and/or modified CDS sequence (AUadapt) from InfluenzaA__ADB89361__HA

SEQ ID NO: 4284 - RNA, 1701 nt, Artificial Sequence; identical to SEQ ID NO: 116
  derived and/or modified CDS sequence (AUadapt) from InfluenzaA__ADB89371__HA

SEQ ID NO: 4285 - RNA, 1701 nt, Artificial Sequence; identical to SEQ ID NO: 3659
  derived and/or modified CDS sequence (AUadapt) from InfluenzaA__ADB89381__HA

SEQ ID NO: 4286 - RNA, 1701 nt, Artificial Sequence
  derived and/or modified CDS sequence (AUadapt) from InfluenzaA__ADB89391__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugccugcacgccggcgcgaaguccuucuacaagaaccucaucuggcuggugaagaaggggaacagcuacccgaagcuguccaagucguacaucaacgacaagggcaaggaggugcucguccugugggggauccaccaccccagcaccuccgccgaccagcagucgcuguaccagaacgccgacgccuacguguucgugggcacgucccgguacagcaagaaguucaagcccgagaucgccauccgccccaagguccgggaccaggagggccgcaugaacuacuacuggacccucguggagccgggggacaagaucaccuucgaggcgaccggcaaccugguggucccccgguacgccuucgccauggagcgcaacgccggguccggcaucaucaucucggacacgcccgugcacgacugcaacacgaccugccagacccccaagggcgccaucaacaccucccugccguuccagaacauccaccccaucaccaucgggaagugccccaaguacgucaagagcaccaagcuccggcuggcgaccggccugcgcaacgugcccuccauccagucgcgggggcuguucggcgccaucgccggguucaucgagggcggcuggacggggaugaucgacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcgcaucgagaaccucaacaagaagguggacgacggcuuccuggacaucuggaccuacaacgccgagcugcucguccugcuggagaacgagcggacccucgacuaccacgacucgaacgugaagaaccuguacgagaaggugcgcucccagcugaagaacaacgccaaggagaucgggaacggcugcuucgaguucuaccacaagugcgacaacacgugcauggagagcgucaagaacgggaccuacgacuacccgaaguacuccgaggaggccaagcucaaccgggaggagaucgacggcgugaagcuggagucgacccgcaucuaccagauccuggcgaucuacuccaccguggccagcucgcucguccugguggugucccugggggccaucagcuucuggaugugcuccaacggcagccuccagugccggaucugcaucuga

SEQ ID NO: 4287 - RNA, 1701 nt, Artificial Sequence; identical to SEQ ID NO: 62
  derived and/or modified CDS sequence (AUadapt) from InfluenzaA__ADB89401__HA

SEQ ID NO: 4288 - RNA, 1701 nt, Artificial Sequence; identical to SEQ ID NO: 116
  derived and/or modified CDS sequence (AUadapt) from InfluenzaA__ADB89411__HA

SEQ ID NO: 4289 - RNA, 1701 nt, Artificial Sequence; identical to SEQ ID NO: 3361
  derived and/or modified CDS sequence (AUadapt) from InfluenzaA__ADB89431__HA

SEQ ID NO: 4290 - RNA, 1701 nt, Artificial Sequence; identical to SEQ ID NO: 3267
  derived and/or modified CDS sequence (AUadapt) from InfluenzaA__ADB89441__HA

SEQ ID NO: 4291 - RNA, 1701 nt, Artificial Sequence; identical to SEQ ID NO: 116
  derived and/or modified CDS sequence (AUadapt) from InfluenzaA__ADB89461__HA

SEQ ID NO: 4292 - RNA, 1701 nt, Artificial Sequence; identical to SEQ ID NO: 3361
  derived and/or modified CDS sequence (AUadapt) from InfluenzaA__ADB89481__HA

SEQ ID NO: 4293 - RNA, 1701 nt, Artificial Sequence; identical to SEQ ID NO: 3361
  derived and/or modified CDS sequence (AUadapt) from InfluenzaA__ADB89491__HA

SEQ ID NO: 4294 - RNA, 1701 nt, Artificial Sequence
  derived and/or modified CDS sequence (AUadapt) from InfluenzaA__ADB89501__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgucgauccagucccgggggcuguucggcgccaucgccggguucaucgagggcggcuggaccgggcucguggacggcugguacggguaccaccaccagaacgagcagggcagcggguacgccgccgaccugaaguccacgcagaacgcgaucgacgagaucaccaacaaggugaacucggucaucgagaagaugaacacccaguucaccgccgugggcaaggaguucaaccaccuggagaagcgcaucgagaaccucaacaagaaggucgacgacggcuuccuggacaucuggacguacaacgccgagcugcucgugcugcuggagaacgagcggacccucgacuaccacgacuccaacgugaagaaccuguacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcucaaccgggaggagaucgacggcgugaagcuggaguccacccgcaucuaccagauccuggcgaucuacagcaccgucgccucgucccucgugcugguggucagccugggggccaucuccuucuggaugugcagcaacggcucccuccagugccggaucugcaucuga

SEQ ID NO: 4295 - RNA, 1701 nt, Artificial Sequence; identical to SEQ ID NO: 116
  derived and/or modified CDS sequence (AUadapt) from InfluenzaA__ADB89511__HA

SEQ ID NO: 4296 - RNA, 1701 nt, Artificial Sequence; identical to SEQ ID NO: 3361
  derived and/or modified CDS sequence (AUadapt) from InfluenzaA__ADB89531__HA

SEQ ID NO: 4297 - RNA, 1701 nt, Artificial Sequence; identical to SEQ ID NO: 3361
  derived and/or modified CDS sequence (AUadapt) from InfluenzaA__ADB89541__HA

SEQ ID NO: 4298 - RNA, 1701 nt, Artificial Sequence; identical to SEQ ID NO: 4074
  derived and/or modified CDS sequence (AUadapt) from InfluenzaA__ADB89551__HA

SEQ ID NO: 4299 - RNA, 1701 nt, Artificial Sequence; identical to SEQ ID NO: 116
  derived and/or modified CDS sequence (AUadapt) from InfluenzaA__ADB89561__HA

SEQ ID NO: 4300 - RNA, 1701 nt, Artificial Sequence; identical to SEQ ID NO: 116
  derived and/or modified CDS sequence (AUadapt) from InfluenzaA__ADB89571__HA

SEQ ID NO: 4301 - RNA, 1701 nt, Artificial Sequence; identical to SEQ ID NO: 116
  derived and/or modified CDS sequence (AUadapt) from InfluenzaA__ADB89581__HA

SEQ ID NO: 4302 - RNA, 1701 nt, Artificial Sequence
  derived and/or modified CDS sequence (AUadapt) from InfluenzaA__ADB89591__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggagcaggagggccgcaugaacuacuacugggcgcugguggagcccggggacaagaucaccuucgaggccaccggcaaccucguggucccccgguacgccuucgccauggagcgcaacgccggguccggcaucaucaucucggacacccccgugcacgacugcaacacgaccugccagaccccgaagggcgcgaucaacaccucccugcccuuccagaacauccacagcaucacgaucgggaagugccccaaguacgugaaguccaccaagcugcggcucgccaccggccugcgcaacguccccucgauccagucccgggggcuguucggcgccaucgccggguucaucgagggcggcuggaccgggaugguggacggcugguacggguaccaccaccagaacgagcagggcagcggguacgccgcggaccucaaguccacgcagaacgccaucgacgagaucaccaacaaggugaacucggucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuacccgaaguacucggaggaggcgaagcugaaccgggaggagaucgacggcgugaagcucgaguccacccgcaucuaccagauccuggccaucuacagcaccgucgccucgucccuggugcucguggucagccugggggccaucuccuucuggaugugcagcaacggcucccugcagugccggaucugcaucuga

SEQ ID NO: 4303 - RNA, 1701 nt, Artificial Sequence
  derived and/or modified CDS sequence (AUadapt) from InfluenzaA__ADB89601__HA
augaaggccaucaucgugguccugcucuacaccuucgccaccgcgaacgccgacacgcugugcaucggcuaccacgccaacaacucgaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccagcuccgacaacggcacgugcuaccccggcgacuucaucgacuacgaggagcugcgggagcagcucucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcuggugaagaaggggaacucguaccccaagcucuccaagagcuacaucaacgacaagggcaaggaggugcugguccugugggggauccaccaccccucgaccuccgccgaccagcagagccucuaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucgccauggagcgcaacgccggguccggcaucaucaucagcgacacgcccgugcacgacugcaacacgaccugccagaccccgaagggcgccaucaacaccucccuccccuuccagaacauccaccccaucaccaucgggaagugccccaaguacgucaagucgaccaagcugcggcuggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcuggagagcacccgcaucuaccagauccucaccaucuacuccaccgucgcgucgagccuggugcugguggucucccucggggccaucucguucuggaugugcuccaacggcagccugcagugccggaucugcaucuga

SEQ ID NO: 4304 - RNA, 1701 nt, Artificial Sequence; identical to SEQ ID NO: 4078
  derived and/or modified CDS sequence (AUadapt) from InfluenzaA__ADB89611__HA

SEQ ID NO: 4305 - RNA, 1701 nt, Artificial Sequence; identical to SEQ ID NO: 4078
  derived and/or modified CDS sequence (AUadapt) from InfluenzaA__ADB89621__HA

SEQ ID NO: 4306 - RNA, 1701 nt, Artificial Sequence
  derived and/or modified CDS sequence (AUadapt) from InfluenzaA__ADB89631__HA
augaaggccauccugaucgugcuccuguacaccuucgccaccgcgaacgccgacacgcugugcaucggcuaccacgccaacaacucgaccgacaccgucgacaccgugcucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagucgcuguccaccgccagcuccuggucguacaucgucgagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggugaccgccgccugcccgcacgccggcgcgaaguccuucuacaagaaccugaucuggcucgucaagaaggggaacucguaccccaagcuguccaagagcuacaucaacgacaagggcaaggaggugcuggugcucugggggauccaccaccccucgaccuccgccgaccagcagagccuguaccagaacgccgacgccuacgucuucgugggcacgucccgguacucgaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacaucccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgugaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgucaagcucgagagcacccgcaucuaccagauccuggcgaucuacuccaccguggccucgagccuggugcucgucgugucccugggggccaucucguucuggaugugcuccaacggcagccugcagugccggaucugcaucuga

SEQ ID NO: 4307 - RNA, 1701 nt, Artificial Sequence; identical to SEQ ID NO: 4078
  derived and/or modified CDS sequence (AUadapt) from InfluenzaA__ADB89641__HA

SEQ ID NO: 4308 - RNA, 1701 nt, Artificial Sequence; identical to SEQ ID NO: 116
  derived and/or modified CDS sequence (AUadapt) from InfluenzaA__ADB89651__HA

SEQ ID NO: 4309 - RNA, 1701 nt, Artificial Sequence; identical to SEQ ID NO: 116
  derived and/or modified CDS sequence (AUadapt) from InfluenzaA__ADB89661__HA

SEQ ID NO: 4310 - RNA, 1701 nt, Artificial Sequence; identical to SEQ ID NO: 4078
  derived and/or modified CDS sequence (AUadapt) from InfluenzaA__ADB89671__HA

SEQ ID NO: 4311 - RNA, 1701 nt, Artificial Sequence; identical to SEQ ID NO: 116
  derived and/or modified CDS sequence (AUadapt) from InfluenzaA__ADB89681__HA

SEQ ID NO: 4312 - RNA, 1701 nt, Artificial Sequence; identical to SEQ ID NO: 116
  derived and/or modified CDS sequence (AUadapt) from InfluenzaA__ADB89691__HA

SEQ ID NO: 4313 - RNA, 1701 nt, Artificial Sequence; identical to SEQ ID NO: 4016
  derived and/or modified CDS sequence (AUadapt) from InfluenzaA__ADB89701__HA

SEQ ID NO: 4314 - RNA, 1701 nt, Artificial Sequence
  derived and/or modified CDS sequence (AUadapt) from InfluenzaA__ADB89711__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccggcaacggcacgugcuaccccggggacuucaucgacuacgaggagcuccgggagcagcugucguccgugagcuccuucgagcgcuucgagaucuuccccaagaccucguccuggcccaaccacgacucgaacaagggcgucaccgccgccugcccgcacgccggggcgaaguccuucuacaagaaccugaucuggcucgugaagaagggcaacagcuaccccaagcuguccaagucguacaucaacgacaaggggaaggaggugcugguccucuggggcauccaccaccccagcaccuccgccgaccagcagucgcuguaccagaacgccgacgccuacguguucgugggcacgucccgguacagcaagaaguucaagcccgagaucgccauccgcccgaagguccgggaccaggaggggcgcaugaacuaccacuggacccugguggagcccggcgacaagaucaccuucgaggcgaccgggaaccucguggucccccgguacgccuucgccauggagcgcaacgccggcuccggcaucaucaucucggacacgcccgugcacgacugcaacacgaccugccagaccccgaagggggccaucaacaccucccugcccuuccagaacauccaccccaucaccaucggcaagugccccaaguacgucaagagcaccaagcugcggcucgcgaccgggcugcgcaacgugccguccauccagucgcggggccuguucggggccaucgccggcuucaucgagggcggguggacgggcaugguggacgggugguacggcuaccaccaccagaacgagcagggguccggcuacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcucgagagcacccgcaucuaccagauccuggcgaucuacuccaccgucgccucgagccuggugcucguggucucccugggcgccaucucguucuggaugugcuccaacggcagccugcagugccggaucugcaucuga

SEQ ID NO: 4315 - RNA, 1701 nt, Artificial Sequence
  derived and/or modified CDS sequence (AUadapt) from InfluenzaA__ADB89721__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucgacaacgagucguucaacuggaccggggugacccagaacggcaccuccucggccugcauccgccgguccaagaacagcuucuucucccgccugaacuggcucacgcaccugaacuucaaguaccccgcccugaacgugaccaugcccaacaacgagcaguucgacaagcucuaccuguggggcguccaccaccccgggaccgacaaggaccagaucuuccuguacgcgcaggccucggggcggaucaccguguccacgaagcgcagccagcagaccgugaucccgaacaucggcucgcggccccgcguccggaacauccccucccgcaucagcaucuacuggaccaucgugaagcccggcgacauccuccugaucaacuccaccgggaaccugaucgccccgcggggcuacuucaagauccagucggggaaguccucgaucaugcgcuccgacgcccccaucggcaagugcaacagcgagugcaucacgcccaacggcuccauccccaacgacaagccguuccagaacgugaaccggaucaccuacggggccugcccccgcuacgucaagcagaacacccucaagcuggcgaccggcaugcggaacgugcccgagaagcagacgcgcgggaucuucggcgccaucgccggguucaucgagaacggcugggagggcaugguggacgggugguacggcuuccggcaccagaacucggaggggcgcggccaggccgccgaccugaaguccacccaggcggccaucgaccagaucaacgggaagcucaaccggcugaucggcaagaccaacgagaaguuccaccagaucgagaaggaguucagcgaggucgagggccgcauccaggaccuggagaaguacguggaggacaccaagaucgaccucugguccuacaacgccgagcugcugguggcccucgagaaccagcacacgaucgaccugaccgacucggagaugaacaagcuguucgagaagaccaagaagcagcuccgggagaacgccgaggacauggggaacggcugcuucaagaucuaccacaagugcgacaacgcgugcaucggguccauccgcaacggcaccuacgaccacgacgucuaccgcgacgaggcccugaacaaccgguuccagaucaaggggguggagcugaaguccggcuacaaggacuggauccucuggaucuccuucgccaucagcugcuuccugcugugcguggcccuccugggcuucaucaugugggccugccagaaggggaacauccgcugcaacaucugcaucuga

SEQ ID NO: 4316 - RNA, 1701 nt, Artificial Sequence
  derived and/or modified CDS sequence (AUadapt) from InfluenzaA__ADB90360__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccagcuccaacaacggcacgugcuaccccggcgacuucaucgacuacgaggagcuccgggagcagcugucguccgugagcuccuucgagcgcuucgagaucuuccccaagaccucguccuggcccaaccacgacccgaacaagggggucaccgccgccugcccccacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacguguucgugggcacgucgcgguacuccaagaaguucaagccggagaucgccauccgccccaagguccggggccaggaggggcgcaugaacuacuacuggacccugguggagcccggcgacaagaucaccuucgaggcgaccgggaaccucguggucccccgguacgccuucgccauggagcgcaacgccggcagcggcaucaucaucuccgacacgccggugcacgacugcaacacgaccugccagacccccaagggggccaucaacaccucgcugcccuuccagaacauccaccccaucaccaucggcaagugcccgaaguacgugaaguccaccaagcugcggcucgcgaccgggcugcgcaacauccccagcauccagucccggggccuguucggggccaucgccggcuucaucgagggcggguggacgggcauggucgacgggugguacggcuaccaccaccagaacgagcaggggucgggcuacgccgccgaccucaaguccacccagaacgcgaucgacgagaucaccaacaaggugaacagcgugaucgagaagaugaacacccaguucacggccgucggcaaggaguucaaccaccuggagaagcgcaucgagaaccugaacaagaagguggacgacggguuccucgacaucuggaccuacaacgccgagcugcugguccuccuggagaacgagcggacccuggacuaccacgacuccaacgugaagaaccucuacgagaaggugcgcucgcagcugaagaacaacgccaaggagaucggcaacgggugcuucgaguucuaccacaagugcgacaacacgugcauggaguccgucaagaacggcaccuacgacuaccccaaguacagcgaggaggccaagcugaaccgggaggagaucgacggggugaagcucgaguccacccgcaucuaccagauccuggcgaucuacucgaccguggccuccagccugguccucguggugucgcugggcgccaucuccuucuggaugugcagcaacggcucccugcagugccggaucugcaucuga

SEQ ID NO: 4317 - RNA, 1701 nt, Artificial Sequence
  derived and/or modified CDS sequence (AUadapt) from InfluenzaA__ADB90370__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacccgaacaagggggucaccgccgccugcccccacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacguguucgugggcacgucgcgguacuccaagaaguucaagccggagaucgccauccgccccaagguccggggccaggaggggcgcaugaacuacuacuggacccugguggagcccggcgacaagaucaccuucgaggcgaccgggaaccucguggucccccgguacgccuucgccauggagcgcaacgccggcagcggcaucaucaucuccgacacgccggugcacgacugcaacacgaccugccagacccccaagggggccaucaacaccucgcugcccuuccagaacauccaccccaucaccaucggcaagugcccgaaguacgugaaguccaccaagcugcggcucgcgaccgggcugcgcaacguccccagcauccagucccggggccuguucggggccaucgccggcuucaucgagggcggguggacgggcaugguggacgggugguacggcuaccaccaccagaacgagcaggggucgggcuacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcaucuaccagauccuggcgaucuacucgaccgucgccuccagccuggugcucguggucucgcugggcgccaucuccuucuggaugugcagcaacggcucccugcagugccggaucugcaucuga

SEQ ID NO: 4318 - RNA, 1701 nt, Artificial Sequence; identical to SEQ ID NO: 3833
  derived and/or modified CDS sequence (AUadapt) from InfluenzaA__ADB90414__HA

SEQ ID NO: 4319 - RNA, 1701 nt, Artificial Sequence; identical to SEQ ID NO: 3361
  derived and/or modified CDS sequence (AUadapt) from InfluenzaA__ADC32409__HA

SEQ ID NO: 4320 - RNA, 1701 nt, Artificial Sequence
  derived and/or modified CDS sequence (AUadapt) from InfluenzaA__ADC32410__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagaagacccuggacuaccacgacagcaacgugaagaaccucuacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggcgaucuacuccaccgucgccucgagccuggugcucguggucucccugggggccaucucguucuggaugugcuccaacggcagccugcagugccgcaucugcaucuga

SEQ ID NO: 4321 - RNA, 1701 nt, Artificial Sequence
  derived and/or modified CDS sequence (AUadapt) from InfluenzaA__ADC32411__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccacagcaucaccaucgggaagugccccaaguacgugaaguccaccaagcugcggcucgcgaccggccugcgcaacguccccucgauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacucggucaucgagaagaugaacacccaguucacggccgugggcaaggaguucaaccaccuggccaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuacccgaaguacucggaggaggcgaagcugaaccgggaggagaucgacggcgugaagcucgaguccacccgcaucuaccagauccuggccaucuacagcaccgucgccucgucccuggugcucguggucagccugggggccaucuccuucuggaugugcagcaacggcucccugcagugccggaucugcaucuga

SEQ ID NO: 4322 - RNA, 1701 nt, Artificial Sequence; identical to SEQ ID NO: 3267
  derived and/or modified CDS sequence (AUadapt) from InfluenzaA__ADC32412__HA

SEQ ID NO: 4323 - RNA, 1701 nt, Artificial Sequence; identical to SEQ ID NO: 116
  derived and/or modified CDS sequence (AUadapt) from InfluenzaA__ADC32413__HA

SEQ ID NO: 4324 - RNA, 1701 nt, Artificial Sequence; identical to SEQ ID NO: 3361
  derived and/or modified CDS sequence (AUadapt) from InfluenzaA__ADC32414__HA

SEQ ID NO: 4325 - RNA, 1701 nt, Artificial Sequence; identical to SEQ ID NO: 3361
  derived and/or modified CDS sequence (AUadapt) from InfluenzaA__ADC32415__HA

SEQ ID NO: 4326 - RNA, 1701 nt, Artificial Sequence; identical to SEQ ID NO: 3361
  derived and/or modified CDS sequence (AUadapt) from InfluenzaA__ADC32416__HA

SEQ ID NO: 4327 - RNA, 1701 nt, Artificial Sequence
  derived and/or modified CDS sequence (AUadapt) from InfluenzaA__ADC32417__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaguacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcaacaacacgugcauggagagcgugaagaacgggaccuacgacuaccccaaguacuccgaggaggccaagcugaaccgggaggagaucgacggcgugaagcucgagucgacccgcaucuaccagauccuggcgaucuacuccaccgucgccagcucgcuggugcucguggucucccugggggccaucagcuucuggaugugcuccaacggcagccugcagugccggaucugcaucuga

SEQ ID NO: 4328 - RNA, 1701 nt, Artificial Sequence; identical to SEQ ID NO: 3361
  derived and/or modified CDS sequence (AUadapt) from InfluenzaA__ADC32418__HA

SEQ ID NO: 4329 - RNA, 1701 nt, Artificial Sequence
  derived and/or modified CDS sequence (AUadapt) from InfluenzaA__ADC32419__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccacucgaucaccaucgggaagugccccaaguacgugaaguccaccaagcugcggcucgcgaccggccugcgcaacguccccagcauccagucccgggggcuguucggcgccaucgccggguucaucgagggcggcuggacggggaugguggacggcugguucggguaccaccaccagaacgaccagggcagcgccuacgccgcggaccucaaguccacccagaacgccaucgacgagaucaccaacaaggugaacucggucaucgagaagaugaacacccaguucacggccguggggaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucggcaacgggugcuucgaguucuaccacaagugcgacaacacgugcauggaguccgugaagaacggcaccuacgacuacccgaaguacucggaggaggcgaagcugaaccgggaggagaucgacggggugaagcucgaguccacccgcaucuaccagauccuggccaucuacagcaccgucgccucgucccuggugcucguggucagccugggcgccaucuccuucuggaugugcagcaacgggucccugcagugccggaucugcaucuga

SEQ ID NO: 4330 - RNA, 1701 nt, Artificial Sequence; identical to SEQ ID NO: 3361
  derived and/or modified CDS sequence (AUadapt) from InfluenzaA__ADC32420__HA

SEQ ID NO: 4331 - RNA, 1701 nt, Artificial Sequence; identical to SEQ ID NO: 3361
  derived and/or modified CDS sequence (AUadapt) from InfluenzaA__ADC32421__HA

SEQ ID NO: 4332 - RNA, 1701 nt, Artificial Sequence
  derived and/or modified CDS sequence (AUadapt) from InfluenzaA__ADC32422__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggagcaggagggccgcaugaacuacuacuggacccugguggagcccggggacaagaucaccuucgaggcgaccggcaaccucauggugccccgguacgccuucgccauggagcgcaacgccggguccggcaucaucaucucggacacgcccguccacgacugcaacacgaccugccagaccccgaagggcgccaucaacaccucccugcccuuccagaacauccacagcaucaccaucgggaagugccccaaguacgugaaguccaccaagcugcggcucgcgaccggccugcgcaacgugcccucgauccagucccgggggcuguucggcgccaucgccggguucaucgagggcggcuggacggggauggucgacggcugguacggguaccaccaccagaacgagcagggcagcggguacgccgccgaccucaaguccacccagaacgcgaucgacgagaucaccaacaaggugaacucggugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuacccgaaguacucggaggaggccaagcugaaccgggaggagaucgacggcgugaagcucgaguccacccgcaucuaccagauccuggcgaucuacagcaccguggccucgucccugguccucguggugagccugggggccaucuccuucuggaugugcagcaacggcucccugcagugccggaucugcaucuga

SEQ ID NO: 4333 - RNA, 1701 nt, Artificial Sequence
  derived and/or modified CDS sequence (AUadapt) from InfluenzaA__ADC32423__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccacagcaucaccaucgggaagugccccaaguacgugaaguccaccaagcugcggcucgcgaccggccugcgcaacguccccucgauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacucggucaucgagaagaugaacacccaguucacggccgugggcaaggaguucaaccaccuggagaagcgcaucgagaaccugaacaagaaggucaacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuacccgaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 4334 - RNA, 1701 nt, Artificial Sequence
  derived and/or modified CDS sequence (AUadapt) from InfluenzaA__ADC32434__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagcacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 4335 - RNA, 1701 nt, Artificial Sequence; identical to SEQ ID NO: 4334
  derived and/or modified CDS sequence (AUadapt) from InfluenzaA__ADC32435__HA

SEQ ID NO: 4336 - RNA, 1701 nt, Artificial Sequence
  derived and/or modified CDS sequence (AUadapt) from InfluenzaA__ADC34940__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagcgcuucaacuggaccggcgugacccagaacgggaccucguccgccugcaagcggggcagcgacaacuccuucuucucgcgccugaacuggcucacgcaccugaaguucaaguaccccgcccugaacgugaccaugcccaacaacgagaaguucgacaagcucuacaucuggggcguccaccaccccgggaccgacaacgaccagaucuuccugcacgcgcaggccuccggccggaucaccgugucgacgaagcgcucccagcagaccgugaucccgaacaucgggagccggccccgcguccggaacauccccucgcgcaucuccaucuacuggaccaucgugaagcccggcgacauccugcucaucaacucgaccgggaaccugaucgccccgcggggcuacuucaagauccgcuccggcaagagcuccaucaugaaguccgacgcccccaucgggaagugcaacuccgagugcaucacgcccaacggcucgauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggcuucaucgagaacgggugggagggcaugguggacgggugguacggcuuccggcaccagaacuccgaggggaucggccaggccgccgaccucaagucgacccaggcggccaucaaccagaucaacggcaagcugaaccgccugaucgggaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgaucgaccucaccgacuccgagaugaacaagcuguucgagcgcaccaagaagcagcugcgggagaacgccgaggacauggggaacggcugcuucaagaucuaccacaagugcgacaacgcgugcaucgggucgauccgcaacggcaccuacgaccacgacgucuaccgcgacgaggcccucaacaaccgguuccagaucaagggcguggagcugaaguccggguacaaggacuggauccuguggaucagcuucgccaucuccugcuuccuccugugcguggcccugcucggcuucaucaugugggccugccagaaggggaacauccgcugcaacaucugcaucuga

SEQ ID NO: 4337 - RNA, 1701 nt, Artificial Sequence; identical to SEQ ID NO: 4249
  derived and/or modified CDS sequence (AUadapt) from InfluenzaA__ADC38987__HA

SEQ ID NO: 4338 - RNA, 1701 nt, Artificial Sequence
  derived and/or modified CDS sequence (AUadapt) from InfluenzaA__ADC38997__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggacgugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 4339 - RNA, 1701 nt, Artificial Sequence; identical to SEQ ID NO: 4015
  derived and/or modified CDS sequence (AUadapt) from InfluenzaA__ADC39007__HA

SEQ ID NO: 4340 - RNA, 1698 nt, Artificial Sequence
  derived and/or modified CDS sequence (AUadapt) from InfluenzaA__ADC45604__HA
augaaggccaagcugcucgugcugcugugcaccuucaccgccacguacgcggacaccaucugcaucggcuaccacgccaacaacucgaccgacaccgucgacacggugcucgagaagaacgugaccgucacccacuccgugaaccugcuggagaacagccacaacgggaagcucugccugcugaagggcaucgcgccccuccagcuggggaacugcuccguggccggcuggauccuggggaacccggagugcgagcuccugaucucgaaggaguccuggagcuacaucgucgagaagcccaaccccgagaacgggaccugcuaccccggccacuucgccgacuacgaggagcugcgcgagcagcucuccagcguguccucguucgagcgguucgagaucuucccgaaggaguccagcuggcccaaccacacggugaccggggucuccgccagcugcucccacaacggcgagucguccuucuaccgcaaccugcuguggcucaccgggaagaacggccuguaccccaaccugagcaaguccuacgccaacaacaaggagaaggaggugcucgugcuguggggcguccaccacccgcccaacaucggcgaccagaaggcccuguaccacaccgagaacgccuacgugagcguggucucgucccacuacagccggaaguucacgcccgagaucgcgaagcgccccaaggugcgggaccaggagggccgcaucaacuacuacuggacccuccuggagcccggggacaccaucaucuucgaggccaacggcaaccugaucgccccgcgguacgccuucgcccucucccgcgggcugggcucgggcaucaucaacuccaacgcgcccauggacaagugcgacgccaagugccagacgccccagggggccaucaacagcucccugcccuuccagaacgugcacccggucaccaucggcgagugccccaaguacgugcggagcgccaagcuccgcauggugaccgggcugcggaacauccccuccauccagucgcgcggccuguucggggccaucgcgggcuucaucgagggcggguggaccggcauggucgacgggugguacggcuaccaccaccagaacgagcagggguccggcuacgccgccgaccagaaguccacccagaacgccaucaacggcaucacgaacaaggugaacagcgugaucgagaagaugaacacccaguucaccgccgucgggaaggaguucaacaagcucgagcggcgcauggagaaccugaacaagaagguggacgacggcuucaucgacaucuggaccuacaacgcggagcugcucguccugcuggagaacgagcggacgcucgacuuccacgacagcaacgugaagaaccuguacgagaaggugaagucccagcugaagaacaacgccaaggagaucgggaacggcugcuucgaguucuaccacaagugcaacgacgagugcauggagucggucaagaacgggaccuacgacuaccccaaguacuccgaggagagcaagcucaaccgcgagaagaucgacggcgugaagcuggaguccaugggcguguaccagauccuggccaucuacagcaccgucgccucgucccucgugcugcuggugagccucggggccaucuccuucuggaugugcagcaacggcucccugcagugccggaucugcaucuga

SEQ ID NO: 4341 - RNA, 1698 nt, Artificial Sequence
  derived and/or modified CDS sequence (AUadapt) from InfluenzaA__ADC45626__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacaaccacaacgggaagcucugccugcugaagggcaucgcgccccuccagcuggggaacugcagcgucgccggcuggauccuggggaacccggagugcgagcuccugaucuccaaggagagcugguccuacaucguggagaagcccaaccccgagaacgggaccugcuaccccggccacuucgccgacuacgaggagcugcgcgagcagcucagcuccgugucguccuucgagcgguucgagaucuucccgaaggagagcuccuggcccaaccacacggucaccggggugagcgccuccugcagccacaacggcgaguccucguucuacaagaaccugcuguggcucaccgggaagaacggccuguaccccaaccuguccaagagcuacgccaacaacaaggagaaggaggugcucguccuguggggcgugcaccacccgcccaacaucggcaaccagaugacccuguaccacaaggagaacgccuacguguccgucgugagcagccacuacucccgcaaguucacgcccgagaucgccaagcggcccaaggugcgcgaccaggagggccggaucaacuacuacuggacccuccuggagcccggggacaccaucaucuucgaggccucgggcaaccugaucgcgccgcgcuacgccuucgcccucucccggggguucggcagcggcaucaucaacuccaacgcccccauggacgagugcgacgccaagugccagacgccccagggggcgaucaacagcucccugcccuuccagaacguccacccggugaccaucggcgagugccccaaguacgugcgcagcgccaagcugcggauggucaccgggcuccgcaacauccccuccauccagucgcggggccuguucggggccaucgccggcuucaucgagggcggguggaccggcaugguggacgggugguacggcuaccaccaccagaacgagcagggguccggcuacgccgcggaccagaaguccacccagaacgccaucaacggcaucacgaacaaggugaacagcgucaucgagaagaugaacacccaguucaccgccguggggaaggaguucaacaagcuggagcgccggauggagaaccucaacaagaaggucgacgacggcuucaucgacguguggaccuacaacgccgagcugcuggugcuccuggagaacgagcgcacgcuggacuuccacgacagcaacgucaagaaccucuacgagaaggugaagaaccagcugaagaacaacgccaaggagaucgggaacggcugcuucgaguucuaccacaagugcaacgacgagugcauggaguccgugaagaacgggaccuacgacuaccccaaguacagcgaggaguccaagcugucgcgggagaagaucgacggcgucaagcucgaguccaugggcguguaccagauccuggcgaucuacagcaccguggccagcucccugguccuccuggugagccugggggccaucuccuucuggaugugcagcaacggcucccuccagugccgcaucugcaucuga

SEQ ID NO: 4342 - RNA, 1698 nt, Artificial Sequence
  derived and/or modified CDS sequence (AUadapt) from InfluenzaA__ADC45637__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacaaccacaacgggaagcucugccugcugaagggcaucgcgccccuccagcuggggaacugcagcgucgccggcuggauccuggggaacccggagugcgagcuccugaucuccaaggagagcugguccuacaucguggagaagcccaaccccgagaacgggaccugcuaccccggccacuucgccgacuacgaggagcugcgcgagcagcucagcuccgugucguccuucgagcgguucgagaucuucccgaaggagagcuccuggcccaaccacacggucaccggggugagcgccuccugcagccacaacggcgaguccucguucuacaagaaccugcuguggcucaccgggaagaacggccuguaccccaaccuguccaagagcuacgccaacaacaaggagaaggaggugcucguccuguggggcgugcaccacccgcccaacaucggcgaccagaugacccuguaccacaaggagaacgccuacguguccgucgugagcagccacuacucccgcaaguucacgcccgagaucgccaagcggcccaaggugcgcgaccaggagggccggaucaacuacuacuggacccuccuggagcccggggacaccaucaucuucgaggccucgggcaaccugaucgcgccgcgcuacgccuucgcccucucccggggguucggcagcggcaucaucaacuccaacgcccccauggacgagugcgacgccaagugccagacgccccagggggcgaucaacagcucccugcccuuccagaacguccacccggugaccaucggcgagugccccaaguacgugcgcagcgccaagcugcggauggucaccgggcuccgcaacauccccuccauccagucgcggggccuguucggggccaucgccggcuucaucgagggcggguggaccggcaugguggacgggugguacggcuaccaccaccagaacgagcagggguccggcuacgccgcggaccagaaguccacccagaacgccaucaacggcaucacgaacaaggugaacagcgucaucgagaagaugaacacccaguucaccgccguggggaaggaguucaacaagcuggagcgccggauggagaaccucaacaagaaggucgacgacggcuucaucgacguguggaccuacaacgccgagcugcuggugcuccuggagaacgagcgcacgcuggacuuccacgacagcaacgucaagaaccucuacgagaaggugaagaaccagcugaagaacaacgccaaggagaucgggaacggcugcuucgaguucuaccacaagugcaacgacgagugcauggaguccgugaagaacgggaccuacgacuaccccaaguacagcgaggaguccaagcugucgcgggagaagaucgacggcgucaagcucgaguccaugggcguguaccagauccuggcgaucuacagcaccguggccagcucccugguccuccuggugagccugggggccaucuccuucuggaugugcagcaacggcucccuccagugccgcaucugcaucuga

SEQ ID NO: 4343 - RNA, 1698 nt, Artificial Sequence
  derived and/or modified CDS sequence (AUadapt) from InfluenzaA__ADC45648__HA
augaaggugaagcugcucguccugcugugcaccuucgccgccaccuacgcggacacgaucugcaucggcuaccacgccaacaacucgaccgacaccguggacaccgugcucgagaagaacgucacggugacccacuccgugaaccugcuggagaacagccacaacgggaagcucugccugcugaagggcaucgcgccccuccagcuggggaacugcuccaucgccggcuggguccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacaccgucacggggguguccgccucgugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugucggucgugagcucccacuacagccggaaguucacccccgagaucgcgaagcgccccaaggugcgggaccaggagggccgcaucaacuacuacuggacgcuccuggagcccggggacaccaucaucuucgaggccaacggcaaccugaucgccccgcgguacgccuucgcccucucccgcggguucggcagcggcaucaucaacuccaacgcgcccauggacaagugcgacgccaagugccagacgccccagggggccaucaacucgucccugcccuuccagaacguccacccggugaccaucggcgagugccccaaguacgugcggagcgccaagcugcgcauggucaccgggcuccggaacauccccuccauccagagccgcggccuguucggggccaucgcgggcuucaucgagggcggguggaccggcaugguggacgggugguacggcuaccaccaccagaacgagcagggguccggcuacgccgccgaccagaaguccacccagaacgccaucaacggcaucaccaacaaggugaacucggucaucgagaagaugaacacgcaguucaccgccguggggaaggaguucaacaagcuggagcggcgcauggagaaccucaacaagaaggucgacgacggcuucaucgacaucuggaccuacaacgcggagcugcuggugcuccuggagaacgagcggacccuggacuuccacgacagcaacgugaagaaccucuacgagaaggucaagucccagcugaagaacaacgccaaggagaucgggaacggcugcuucgaguucuaccacaagugcaacgacgagugcauggagagcgugaagaacgggacguacgacuaccccaaguacuccgaggagagcaagcugaaccgcgagaagaucgacggcgugaagcucgaguccaugggcgucuaccagauccuggccaucuacucgaccguggccagcucccuggugcuccuggucagccugggggccaucuccuucuggaugugcagcaacggcucccuccagugccggaucugcaucuga

SEQ ID NO: 4344 - RNA, 1698 nt, Artificial Sequence
  derived and/or modified CDS sequence (AUadapt) from InfluenzaA__ADC45659__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaagaaguccagcuggcccaaccacacggucaccggcguguccgccucgugcucccacaacggcgagagcuccuucuaccgcaaccugcuguggcucaccgagaagaacgggcuguaccccaaccugagcaaguccuacgccaacaacaaggagaaggaggugcucguccuguggggcgugcaccacccgcccaacaucggggaccagaaggcccuguaccacaccgagaacgccuacgugucggucgugagcucccacuacagccggaaguucacgcccgagaucgccaagcgccccaaggugcgggaccaggagggccgcaucaacuacuacuggacccuccuggagcccggcgacaccaucaucuucgaggcgaacgggaaccugaucgccccgcgguacgccuucgcccucucccgcggcuucgggagcggcaucaucaacuccaacgcccccauggacaagugcgacgcgaagugccagacgccccagggcgccaucaacucgucccugcccuuccagaacguccacccggugaccaucggggagugccccaaguacgugcggagcgccaagcugcgcauggucaccggccuccggaacauccccuccauccagagccgcgggcuguucggcgccaucgccggguucaucgagggcggcuggaccgggaugguggacggcugguacggguaccaccaccagaacgagcagggcuccggguacgcggccgaccagaaguccacccagaacgccaucaacggcaucacgaacaaggugaacucggucaucgagaagaugaacacccaguucaccgccgugggcaaggaguucaacaagcuggagcggcgcauggagaaccucaacaagaaggucgacgacggguucaucgacaucuggaccuacaacgccgagcugcuggugcuccuggagaacgagcggacgcuggacuuccacgacagcaacgugaagaaccucuacgagaaggucaagucccagcugaagaacaacgcgaaggagaucggcaacgggugcuucgaguucuaccacaagugcaacgacgagugcauggagagcgugaagaacggcaccuacgacuaccccaaguacuccgaggagagcaagcugaaccgcgagaagaucgacggggugaagcucgaguccaugggcgucuaccagauccuggccaucuacucgaccguggccagcucccuggugcuccuggucagccugggcgccaucuccuucuggaugugcagcaacgggucccuccagugccggaucugcaucuga

SEQ ID NO: 4345 - RNA, 1698 nt, Artificial Sequence
  derived and/or modified CDS sequence (AUadapt) from InfluenzaA__ADC45670__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccucguggcccaaccacacggucaccgggggcuccgccagcugcucccacaacggggagagcuccuucuaccgcaaccugcuguggcucaccggcaagaacgggcuguaccccaaccugucgaaguccuacgccaacaacaaggagaaggaggugcucgugcuguggggcguccaccacccgcccaacaucggcgaccagaaggcccuguaccacaccgagaacgccuacgugagcguggucagcucccacuacucgcggaaguucacgcccgagaucgccaagcgccccaaggugcgggaccaggaggggcgcaucaacuacuacuggacccuccuggagcccggcgacaccaucaucuucgaggcgaacgggaaccugaucgccccgcgguacgccuucgcccucucccgcggcuucggcagcgggaucaucaacuccaacgcccccauggacaagugcgacgcgaagugccagacgccccagggcgccaucaacagcucccugcccuuccagaacgugcacccggucaccaucggggagugccccaaguacgugcggucggccaagcugcgcauggugaccggccuccggaacauccccuccauccagagccgcgggcuguucggcgccaucgccggcuucaucgagggcggcuggaccgggauggucgacggcugguacggguaccaccaccagaacgagcagggcuccggcuacgcggccgaccagaaguccacccagaacgccaucaacgggaucacgaacaaggugaacagcgugaucgagaagaugaacacccaguucaccgccgucggcaaggaguucaacaagcuggagcggcgcauggagaaccucaacaagaagguggacgacggguucaucgacaucuggaccuacaacgccgagcugcugguccuccuggagaacgagcggacgcuggacuuccacgacucgaacgugaagaaccucuacgagaaggugaagucccagcugaagaacaacgcgaaggagaucggcaacgggugcuucgaguucuaccacaagugcaacgacgagugcauggagagcgucaagaacggcaccuacgacuaccccaaguacuccgaggagagcaagcugaaccgcgagaagaucgacggcgugaagcucgaguccauggggguguaccagauccuggccaucuacucgaccgucgccagcucccuggugcuccuggugagccugggcgccaucuccuucuggaugugcagcaacgggucccuccagugccggaucugcaucuga

SEQ ID NO: 4346 - RNA, 1698 nt, Artificial Sequence
  derived and/or modified CDS sequence (AUadapt) from InfluenzaA__ADC45681__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacaaccacaacgggaagcucugccugcugaagggcaucgcgccccuccagcuggggaacugcagcgucgccggcuggauccuggggaacccggagugcgagcuccugaucuccaaggagagcugguccuacaucguggagaagcccaaccccgagaacgggaccugcuaccccggccacuucgccgacuacgaggagcugcgcgagcagcucucguccgccagcuccuucgagcgguucgagaucuucccgaaggagagcuccuggcccaaccacacggugaccggggucucggccuccugcagccacaacggcgaguccagcuucuacaagaaccugcuguggcucaccgggaagaacggccuguaccccaaccugcgcaaguccuacgccaacaacaaggagaaggaggugcucgugcuguggggcguccaccacccgcccaacaucggcgaccagaugacccuguaccacaaggagaacgccuacgugucgguggucuccagccacuacagccggaaguucacgcccgagaucgccaagcgccccaaggugcgggaccaggagggccgcaucaacuacuacuggacccuccuggagcccggggacaccaucaucuucgaggcguccggcaaccugaucgccccgcgguacgccuucgcccucucgcgcggguucggcuccggcaucaucaacagcaacgcccccauggacgagugcgacgcgaagugccagacgccccagggggccaucaacuccagccugcccuuccagaacgugcacccggucaccaucggcgagugccccaaguacgugcgguccgccaagcugcgcauggugaccgggcuccggaacauccccucgauccagucccgcggccuguucggggccaucgccggcuucaucgagggcggguggaccggcauggucgacgggugguacggcuaccaccaccagaacgagcaggggagcggcuacgcggccgaccagaaguccacccagaacgccaucaacggcaucacgaacaaggugaacagcgugaucgagaagaugaacacccaguucaccgccgucgggaaggaguucaacaagcuggagcggcgcauggagaaccucaacaagaagguggacgacggcuucaucgacgucuggaccuacaacgccgagcugcuggugcuccuggagaacgagcggacgcuggacuuccacgacuccaacgugaagaaccucuacgagaaggucaagaaccagcugaagaacaacgcgaaggagaucgggaacggcugcuucgaguucuaccacaagugcaacgacgagugcauggagucggugaagaacgggaccuacgacuaccccaaguacuccgaggagagcaagcugucccgcgagaagaucgacggcgugaagcucgagagcaugggcgucuaccagauccuggccaucuacuccaccguggccucgagccuggugcuccuggucucccugggggccaucagcuucuggaugugcuccaacggcagccuccagugccggaucugcaucuga

SEQ ID NO: 4347 - RNA, 1698 nt, Artificial Sequence
  derived and/or modified CDS sequence (AUadapt) from InfluenzaA__ADC45692__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaagaaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccucgugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugucggucgugagcucccacuacagccggaaguucacgcccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacaagugcgacgcgaagugccagacgccccagggggccaucaacucgucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacucggucaucgagaagaugaacacccaguucaccgccguggggaaggaguucaacaagcuggagcggcgcauggagaaccucaacaagaaggucgacgacggcuucaucgacaucuggaccuacaacgccgagcugcuggugcuccuggagaacgagcggacgcuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgugaagcucgaguccaugggcgucuaccagauccuggccaucuacucgaccguggccagcucccuggugcuccuggucagccugggggccaucuccuucuggaugugcagcaacggcucccuccagugccggaucugcaucuga

SEQ ID NO: 4348 - RNA, 1698 nt, Artificial Sequence; identical to SEQ ID NO: 3415
  derived and/or modified CDS sequence (AUadapt) from InfluenzaA__ADC45703__HA

SEQ ID NO: 4349 - RNA, 1698 nt, Artificial Sequence
  derived and/or modified CDS sequence (AUadapt) from InfluenzaA__ADC45714__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacaaccacaacgggaagcucugccugcugaagggcaucgcgccccuccagcuggggaacugcagcgucgccggcuggauccuggggaacccggagugcgagcuccugaucuccaaggagagcugguccuacaucguggagaagcccaaccccgagaacgggaccugcuaccccggccacuucgccgacuacgaggagcugcgcgagcagcucucguccgugagcuccuucgagcgguucgagaucuucccgaaggagagcuccuggcccaaccacacggucaccggggugagcgccuccugcucgcacaacggcgaguccagcuucuacaagaaccugcuguggcucaccgggaagaacggccuguaccccaaccuguccaagagcuacgccaacaacaaggagaaggaggugcucguccuguggggcgugcaccacccgcccaacaucggcgaccagaccacgcuguaccacaaggagaacgccuacguguccgucgugucgagccacuacucccgcaaguucacccccgagaucgccaagcggcccaaggugcgcgaccaggagggccggaucaacuacuacuggacccuccuggagcccggggacaccaucaucuucgaggccagcggcaaccugaucgcgccgcgcuacgccuucgcccucucccggggguucggcagcggcaucaucaacuccaacgcccccauggacgagugcgacgccaagugccagacgccccagggggcgaucaacucgucccugcccuuccagaacguccacccggugaccaucggcgagugccccaaguacgugcgcagcgccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgccgcggaccagaaguccacgcagaacgccaucaacggcaucaccaacaaggugaacucggucaucgagaagaugaacacccaguucaccgccguggggaaggaguucaacaagcuggagcgccggauggagaaccucaacaagaaggucgacgacggcuucaucgacguguggacguacaacgccgagcugcuggugcuccuggagaacgagcgcacccuggacuuccacgacagcaacgucaagaaccucuacgagaaggugaagaaccagcugaagaacaacgccaaggagaucgggaacggcugcuucgaguucuaccacaagugcaacgacgagugcauggaguccgugaagaacgggaccuacgacuaccccaaguacagcgaggaguccaagcugagccgggagaagaucgacggcgucaagcucgaguccaugggcguguaccagauccuggcgaucuacucgaccguggccagcucccugguccuccuggugagccugggggccaucuccuucuggaugugcagcaacggcucccuccagugccgcaucugcaucuga

SEQ ID NO: 4350 - RNA, 1698 nt, Artificial Sequence; identical to SEQ ID NO: 3415
  derived and/or modified CDS sequence (AUadapt) from InfluenzaA__ADC45725__HA

SEQ ID NO: 4351 - RNA, 1698 nt, Artificial Sequence
  derived and/or modified CDS sequence (AUadapt) from InfluenzaA__ADC45736__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccucgugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacacguacgugucggucgugagcucccacuacagccggaaguucacccccgagaucgccaagcgccccaaggugcgggaccaggagggccgcaucaacuacuacuggacccuccuggagcccggggacaccaucaucuucgaggccaacggcaaccugaucgcgccgcgguacgccuucgcccucucccgcggguucggcagcggcaucaucaacuccaacgcccccauggacaagugcgacgccaagugccagacgccccagggggcgaucaacucgucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgccgcggaccagaaguccacgcagaacgccaucaacggcaucaccaacaaggugaacucggucaucgagaagaugaacacccaguucaccgccguggggaaggaguucaacaagcuggagcggcgcauggagaaccucaacaagaaggucgacgacggcuucaucgacaucuggacguacaacgccgagcugcuggugcuccuggagaacgagcggacccuggacuuccacgacagcaacgugaagaaccucuacgagaaggucaagucccagcugaagaacaacgccaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgugaagcucgaguccaugggcgucuaccagauccuggcgaucuacucgaccguggccagcucccuggugcuccuggucagccugggggccaucuccuucuggaugugcagcaacggcucccuccagugccggaucugcaucuga

SEQ ID NO: 4352 - RNA, 1698 nt, Artificial Sequence; identical to SEQ ID NO: 2733
  derived and/or modified CDS sequence (AUadapt) from InfluenzaA__ADC45747__HA

SEQ ID NO: 4353 - RNA, 1698 nt, Artificial Sequence
  derived and/or modified CDS sequence (AUadapt) from InfluenzaA__ADC45758__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccucguggcccaaccacacggucaccgggguguccgccagcugcucccacaacggcgagaacagcuucuaccgcaaccugcuguggcucaccgggaagaacggccuguaccccaaccuguccaagucguacgccaacaacaaggagaaggaggugcucguccuguggggcgugcaccacccgcccaacaucgccgaccagaagacccuguaccacacggagaacgccuacguguccgucgugagcagccacuacucccggaaguucacccccgagaucgccaagcgccccaaggugcgggaccaggagggccgcaucaacuacuacuggacccuccuggagcccggcgacaccaucaucuucgaggcgaacgggaaccugaucgccccgcgguacgccuucgcccucucgcgcggcuucggguccggcaucaucaacagcaacgcccccauggacaagugcgacgcgaagugccagacgccccagggcgccaucaacuccagccugcccuuccagaacguccacccggugaccaucggggagugccccaaguacgugcgguccgccaagcugcgcauggucaccggccuccggaacauccccucgauccagucccgcgggcuguucggcgccaucgccggguucaucgagggcggcuggaccgggaugguggacggcugguacggguaccaccaccagaacgagcagggcagcggguacgcggccgaccagaaguccacgcagaacgccaucaacggcaucaccaacaaggugaacagcgucaucgagaagaugaacacccaguucaccgccgugggcaaggaguucaacaagcuggagcggcgcauggagaaccucaacaagaaggucgacgacggguucaucgacaucuggacguacaacgccgagcugcuggugcuccuggagaacgagcggacccugaacuuccacgacuccaacgugaagaaccucuacgagaaggucaagucgcagcugaagaacaacgcgaaggagaucggcaacgggugcuucgaguucuaccacaagugcaacgacgagugcauggaguccgugaagaacggcaccuacgacuaccccaaguacagcgaggaguccaagcugaaccgcgagaagaucgacggggugaagcucgagagcaugggcgucuaccagauccuggccaucuacuccaccguggccucgagccuggugcuccuggucucccugggcgccaucagcuucuggaugugcuccaacgggagccuccagugccggaucugcaucuga

SEQ ID NO: 4354 - RNA, 1698 nt, Artificial Sequence; identical to SEQ ID NO: 3871
  derived and/or modified CDS sequence (AUadapt) from InfluenzaA__ADC45780__HA

SEQ ID NO: 4355 - RNA, 1698 nt, Artificial Sequence; identical to SEQ ID NO: 3376
  derived and/or modified CDS sequence (AUadapt) from InfluenzaA__ADC45791__HA

SEQ ID NO: 4356 - RNA, 1698 nt, Artificial Sequence
  derived and/or modified CDS sequence (AUadapt) from InfluenzaA__ADC45813__HA
augaaggugaagcugcucauccugcugugcaccuucaccgccacguacgccgacaccaucugcaucggcuaccacgcgaacaacucgaccgacaccgucgacacggugcucgagaagaacgugaccgucacccacuccgugaaccugcuggagaacagccacaacgggaagcucugccugcugaagggcaucgcgccccuccagcuggggaacugcuccguggccggcuggauccuggggaacccggagugcgagcuccugaucagcaaggaguccuggagcuacaucgucgagaagcccaaccccgagaacgggaccugcuaccccggccacuucgccgacuacgaggagcugcgcgagcagcucuccucgguguccagcuucgagcgguucgagaucuucccgaaggaguccagcuggcccaaccacacggugaccggcgucuccgccagcugcucccacaacggcgagucguccuucuaccgcaaccugcuguggcucaccaugaagaacgggcuguaccccaaccugagcaaguccuacgccaacaacaaggagaaggaggugcucgugcuguggggcguccaccacccgcccaacaucggggaccagaagacccuguacaacacggagaacgccuacgugagcguggucagcucccacuacucgcggaaguucacccccgagaucgccaagcgccccaaggugcgggaccaggagggccgcaucaacuacuacuggacccuccuggagcccggcgacaccaucaucuucgaggccaacgggaaccugaucgcgccgcgguacgccuucgcccucucccgcggcuucgggagcggcaucaucaacuccaacgcccccauggacaagugcgacgccaagugccagacgccccagggcgcgaucaacagcucccugcccuuccagaacgugcacccggucaccaucggggagugccccaaguacgugcggagcgccaagcugcgcauggugaccggccuccggaacauccccuccauccagucgcgcgggcuguucggcgccaucgccggguucaucgagggcggcuggaccgggauggucgacggcugguacggguaccaccaccagaacgagcagggcuccggguacgccgcggaccagaaguccacgcagaacgccaucaacggcaucaccaacaaggugaacagcgugaucgagaagaugaacacccaguucaccgccgucggcaaggaguucaacaagcuggagcggcgcauggagaaccucaacaagaagguggacgacggguucaucgacaucuggacguacaacgccgagcugcugguccuccuggagaacgagcggacccuggacuuccacgacagcaacgugaagaaccucuacgagaaggugaagucccagcugaagaacaacgccaaggagaucggcaacgggugcuucgaguucuaccacaagugcaacgacgagugcauggagagcgucaagaacggcaccuacgacuaccccaaguacuccgaggagucgaagcugaaccgcgagaagaucgacggggugaagcucgaguccaugggcguguaccagauccuggcgaucuacagcaccgucgccagcucccuggugcuccuggugagccugggcgccaucuccuucuggaugugcagcaacgggucccuccagugccggaucugcaucuga

SEQ ID NO: 4357 - RNA, 1698 nt, Artificial Sequence; identical to SEQ ID NO: 3376
  derived and/or modified CDS sequence (AUadapt) from InfluenzaA__ADC45824__HA

SEQ ID NO: 4358 - RNA, 1698 nt, Artificial Sequence
  derived and/or modified CDS sequence (AUadapt) from InfluenzaA__ADC45835__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccucguggcccaaccacacggucaccgggguguccgccagcugcucccacaacggcgagaacagcuucuaccgcaaccugcuguggcucaccgggaagaacggccuguaccccaaccuguccaagucguacgccaacaacaaggagaaggaggugcucguccuguggggcgugcaccacccgcccaacaucgccgaccagaagacccuguaccacacggagaacgccuacguguccgucgugagcagccacuacucccggaaguucacccccgagaucgccaagcgccccaaggugcgggaccaggagggccgcaucaacuacuacuggacccuccuggagcccggcgacaccaucaucuucgaggcgaacgggaaccugaucgccccgcgguacgccuucgcccucucgcgcggcuucggguccggcaucaucaacagcaacgcccccauggacaagugcgacgcgaagugccagacgccccagggcgccaucaacuccagccugcccuuccagaacguccacccggugaccaucggggagugccccaaguacgugcgguccgccaagcugcgcauggucaccggccuccggaacauccccucgauccagucccgcgggcuguucggcgccaucgccggguucaucgagggcggcuggaccgggaugguggacggcugguacggguaccaccaccagaacgagcagggcagcggguacgcggccgaccagaaguccacgcagaacgccaucaacggcaucaccaacaaggugaacagcgucaucgagaagaugaacacccaguucaccgccgugggcaaggaguucaacaagcuggagcggcgcauggagaaccucaacaagaaggucgacgacggguucaucgacaucuggacguacaacgccgagcugcuggugcuccuggagaacgagcggacccuggacuuccacgacuccaacgugaagaaccucuacgagaaggucaagucgcagcugaagaacaacgcgaaggagaucggcaacgggugcuucgaguucuaccacaagugcaacgacgagugcauggaguccgugaagaacggcaccuacgacuaccccaaguacagcgaggaguccaagcugaaccgcgagaagaucgacggggugacccucgagagcaugggcgucuaccagauccuggccaucuacuccacgguggccucgagccuggugcuccuggucucccugggcgccaucagcuucuggaugugcuccaacgggagccuccagugccggaucugcaucuga

SEQ ID NO: 4359 - RNA, 1698 nt, Artificial Sequence; identical to SEQ ID NO: 2733
  derived and/or modified CDS sequence (AUadapt) from InfluenzaA__ADC45846__HA

SEQ ID NO: 4360 - RNA, 1701 nt, Artificial Sequence; identical to SEQ ID NO: 116
  derived and/or modified CDS sequence (AUadapt) from InfluenzaA__ADC53558__HA

SEQ ID NO: 4361 - RNA, 1701 nt, Artificial Sequence; identical to SEQ ID NO: 3005
  derived and/or modified CDS sequence (AUadapt) from InfluenzaA__ADD14087__HA

SEQ ID NO: 4362 - RNA, 1701 nt, Artificial Sequence; identical to SEQ ID NO: 116
  derived and/or modified CDS sequence (AUadapt) from InfluenzaA__ADD14089__HA

SEQ ID NO: 4363 - RNA, 1701 nt, Artificial Sequence; identical to SEQ ID NO: 116
  derived and/or modified CDS sequence (AUadapt) from InfluenzaA__ADD14093__HA

SEQ ID NO: 4364 - RNA, 1701 nt, Artificial Sequence
  derived and/or modified CDS sequence (AUadapt) from InfluenzaA__ADD14095__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucgugcugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagucgaccaagcuccggcuggcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgugaucgagaagaugaacacccaguucacggccgucggcaaggaguucaaccaccuggagaagcgcaucgagaaccucaacaagaagguggacgacggcuuccuggacaucuggaccuacaacgccgagcugcucguccugcuggagaacgagcggacccucgacuaccacgacagcaacgugaagaaccuguacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcucaaccgggaggagaucgacggcgugaagcuggagagcacccgcaucuaccagauccuggcgaucuacuccaccguggccucgagccucguccugguggugucccugggggccaucucguucuggaugugcuccaacggcagccuccagugccggaucugcaucuga

SEQ ID NO: 4365 - RNA, 1701 nt, Artificial Sequence; identical to SEQ ID NO: 116
  derived and/or modified CDS sequence (AUadapt) from InfluenzaA__ADD14097__HA

SEQ ID NO: 4366 - RNA, 1701 nt, Artificial Sequence; identical to SEQ ID NO: 116
  derived and/or modified CDS sequence (AUadapt) from InfluenzaA__ADD14099__HA

SEQ ID NO: 4367 - RNA, 1701 nt, Artificial Sequence; identical to SEQ ID NO: 116
  derived and/or modified CDS sequence (AUadapt) from InfluenzaA__ADD14101__HA

SEQ ID NO: 4368 - RNA, 1701 nt, Artificial Sequence
  derived and/or modified CDS sequence (AUadapt) from InfluenzaA__ADD14103__HA
augaaggccauccuggugguccuccugugcaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggacaagcgcaucgagaaccugaacaagaagaucgacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgagccugguccucguggugucccugggggccaucucguucuggaugugcuccaacggcagccugcagugccggaucugcaucuga

SEQ ID NO: 4369 - RNA, 1701 nt, Artificial Sequence
  derived and/or modified CDS sequence (AUadapt) from InfluenzaA__ADD14111__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaucuccucguccgacaacgggaccugcuaccccggcgacuucaucgacuacgaggagcuccgggagcagcugagcuccgugucguccuucgagcgcuucgagaucuuccccaagacgagcuccuggcccaaccacgacucgaacaagggcgucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcaccucccgguacagcaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccggguccggcaucaucaucucggacacccccgugcacgacugcaacacgaccugccagaccccgaagggcgccaucaacaccucccugcccuuccagaacauccaccccaucacgaucgggaagugccccaaguacgucaagagcaccaagcugcggcucgcgaccggccugcgcaacgugccguccauccagucgcgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgacccgcaucuaccagauccuggcgaucuacuccaccgucgccagcucgcuggugcucguggucucccugggggccaucagcuucuggaugugcuccaacggcagccugcagugccggaucugcaucuga

SEQ ID NO: 4370 - RNA, 1701 nt, Artificial Sequence; identical to SEQ ID NO: 116
  derived and/or modified CDS sequence (AUadapt) from InfluenzaA__ADD14115__HA

SEQ ID NO: 4371 - RNA, 1701 nt, Artificial Sequence; identical to SEQ ID NO: 116
  derived and/or modified CDS sequence (AUadapt) from InfluenzaA__ADD14117__HA

SEQ ID NO: 4372 - RNA, 1701 nt, Artificial Sequence; identical to SEQ ID NO: 116
  derived and/or modified CDS sequence (AUadapt) from InfluenzaA__ADD14119__HA

SEQ ID NO: 4373 - RNA, 1701 nt, Artificial Sequence; identical to SEQ ID NO: 116
  derived and/or modified CDS sequence (AUadapt) from InfluenzaA__ADD14121__HA

SEQ ID NO: 4374 - RNA, 1701 nt, Artificial Sequence; identical to SEQ ID NO: 116
  derived and/or modified CDS sequence (AUadapt) from InfluenzaA__ADD14123__HA

SEQ ID NO: 4375 - RNA, 1701 nt, Artificial Sequence; identical to SEQ ID NO: 116
  derived and/or modified CDS sequence (AUadapt) from InfluenzaA__ADD14127__HA

SEQ ID NO: 4376 - RNA, 1701 nt, Artificial Sequence
  derived and/or modified CDS sequence (AUadapt) from InfluenzaA__ADD14129__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgccagccugcaccucgggaagugcaacaucgccggcuggauccuggggaaccccgagugcgagucccugucgaccgcguccagcugguccuacaucguggagaccucguccagcgacaacggcacgugcuacccgggcgacuucaucgacuacgaggagcuccgggagcagcuguccucgguguccagcuucgagcgcuucgagaucuuccccaagaccuccucguggcccaaccacgacuccaacaagggggucaccgccgccugcccccacgccggcgccaagagcuucuacaagaaccugaucuggcucgugaagaaggggaacuccuacccgaagcugucgaagagcuacaucaacgacaagggcaaggaggugcugguccucugggggauccaccaccccuccaccucggcggaccagcagucccuguaccagaacgccgacgccuacguguucgugggcacgagccgguacuccaagaaguucaagcccgagaucgccauccgccccaagguccgggaccaggagggccgcaugaacuacuacuggacccugguggagccgggggacaagaucaccuucgaggcgaccggcaaccucguggucccccgguacgccuucgccauggagcgcaacgccgggucgggcaucaucaucuccgacacgcccgugcacgacugcaacacgaccugccagacccccaagggcgccaucaacaccagccugccguuccagaacauccaccccaucaccaucgggaagugccccaaguacgugaaguccaccaagcugcggcucgcgaccggccugcgcaacguccccucgauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacucggucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuacccgaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 4377 - RNA, 1701 nt, Artificial Sequence
  derived and/or modified CDS sequence (AUadapt) from InfluenzaA__ADD14133__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccagcaccuccgccgaccagcagucgcuguaccagaacguggacgccuacguguucgucggcacgucccgguacagcaagaaguucaagcccgagaucgccauccgcccgaaggugcgggaccaggagggccgcaugaacuacuacuggacccugguggagcccggggacaagaucaccuucgaggccaccggcaaccucgucgugccccgguacgcguucgccauggagcgcaacgccggguucggcaucaucaucuccgacacgcccgugcacgacugcaacacgaccugccagaccccgaagggcgccaucaacaccucgcugcccuuccagaacauccaccccaucaccaucgggaagugccccaaguacgucaaguccaccaagcugcggcucgccaccggccugcgcaacgugccgagcauccagucccgggggcuguucggcgcgaucgccggguucaucgagggcggcuggacggggaugguggacggcugguacggguaccaccaccagaacgagcagggcucgggguacgccgccgaccucaaguccacccagaacgccaucgacgagaucaccaacaaggucaacagcgugaucgagaagaugaacacccaguucacggcggucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacuccaacgucaagaaccucuacgagaaggugcgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgucaagcucgaguccacccgcaucuaccagauccuggccaucuacagcaccguggcguccucgcuggugcucgucgugagccugggggccaucuccuucuggaugugcagcaacggcucccugcagugccggaucugcaucuga

SEQ ID NO: 4378 - RNA, 1701 nt, Artificial Sequence; identical to SEQ ID NO: 3005
  derived and/or modified CDS sequence (AUadapt) from InfluenzaA__ADD14135__HA

SEQ ID NO: 4379 - RNA, 1701 nt, Artificial Sequence; identical to SEQ ID NO: 116
  derived and/or modified CDS sequence (AUadapt) from InfluenzaA__ADD14137__HA

SEQ ID NO: 4380 - RNA, 1701 nt, Artificial Sequence; identical to SEQ ID NO: 3662
  derived and/or modified CDS sequence (AUadapt) from InfluenzaA__ADD14139__HA

SEQ ID NO: 4381 - RNA, 1701 nt, Artificial Sequence; identical to SEQ ID NO: 116
  derived and/or modified CDS sequence (AUadapt) from InfluenzaA__ADD14143__HA

SEQ ID NO: 4382 - RNA, 1701 nt, Artificial Sequence; identical to SEQ ID NO: 116
  derived and/or modified CDS sequence (AUadapt) from InfluenzaA__ADD14145__HA

SEQ ID NO: 4383 - RNA, 1701 nt, Artificial Sequence; identical to SEQ ID NO: 116
  derived and/or modified CDS sequence (AUadapt) from InfluenzaA__ADD14147__HA

SEQ ID NO: 4384 - RNA, 1701 nt, Artificial Sequence
  derived and/or modified CDS sequence (AUadapt) from InfluenzaA__ADD14151__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcgggccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgcuacucgaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggcgaucuacuccaccgucgccucgagccuggugcucguggucucccugggggccaucucguucuggaugugcuccaacggcagccugcagugccgcaucugcaucuga

SEQ ID NO: 4385 - RNA, 1701 nt, Artificial Sequence; identical to SEQ ID NO: 116
  derived and/or modified CDS sequence (AUadapt) from InfluenzaA__ADD14153__HA

SEQ ID NO: 4386 - RNA, 1701 nt, Artificial Sequence; identical to SEQ ID NO: 116
  derived and/or modified CDS sequence (AUadapt) from InfluenzaA__ADD14155__HA

SEQ ID NO: 4387 - RNA, 1701 nt, Artificial Sequence; identical to SEQ ID NO: 116
  derived and/or modified CDS sequence (AUadapt) from InfluenzaA__ADD14157__HA

SEQ ID NO: 4388 - RNA, 1701 nt, Artificial Sequence; identical to SEQ ID NO: 116
  derived and/or modified CDS sequence (AUadapt) from InfluenzaA__ADD14162__HA

SEQ ID NO: 4389 - RNA, 1701 nt, Artificial Sequence; identical to SEQ ID NO: 116
  derived and/or modified CDS sequence (AUadapt) from InfluenzaA__ADD14172__HA

SEQ ID NO: 4390 - RNA, 1701 nt, Artificial Sequence; identical to SEQ ID NO: 116
  derived and/or modified CDS sequence (AUadapt) from InfluenzaA__ADD14182__HA

SEQ ID NO: 4391 - RNA, 1701 nt, Artificial Sequence; identical to SEQ ID NO: 116
  derived and/or modified CDS sequence (AUadapt) from InfluenzaA__ADD14192__HA

SEQ ID NO: 4392 - RNA, 1701 nt, Artificial Sequence; identical to SEQ ID NO: 116
  derived and/or modified CDS sequence (AUadapt) from InfluenzaA__ADD14202__HA

SEQ ID NO: 4393 - RNA, 1701 nt, Artificial Sequence
  derived and/or modified CDS sequence (AUadapt) from InfluenzaA__ADD21447__HA
augaaggccauccugguguuccuccuguacaccuucgccaccgcgaacgccgacacgcugugcaucggcuaccacgccaacaacucgaccgacaccgucgacaccgugcucgagaagaacgugacggucacccacuccgugaaccugcuggaggaccgccacaacgggaagcucugcaagcugcggggcguggcgccccugcaccucgggaagugcaacaucgccggcuggcugcuggggaacccggagugcgagcuccuguucaccgccucguccuggagcuacaucgucgagaccuccaacucggacaacggcacgugcuaccccggcgacuucaucaacuacgaggagcugcgcgagcagcucuccagcguguccucguucgagcgguucgagauguuccccaaguccagcuccuggcccaaccacgagaccaaccgcggggugaccgccgccugcccguacgccggcgcgaacucguucuaccggaaccugaucuggcuggucaagaaggagaacuccuaccccaagcucagcaaguccuacaucaacaacaaggagaaggaggugcuggugcugugggggauccaccacccgcccaccucggccgaccagcagucccucuaccagaacgccgacgccuacgucuucgugggcagcucgaaguacaacaagaaguuccgccccgagaucgccgcgcggcccaaggugcgcgggcagacgggccggaugaacuacuacuggacccuggucgagcccggcgacaccaucaccuucgaggccacggagaaccugguggugccccgcuacgccuucgccaugaagcggggguccggcagcgggaucaucaucuccgacaccccgguccacgacugcaacacgaccugccagacccccaagggcgccaucaacaccucgcuccccuuccagaacauccaccccgugaccaucggcgagugcccgaaguacgugaaguccaccaaccugcgcauggcgacggggcugcggaacauccccagcauccagucccgcggccucuucggggccaucgccggcuucaucgagggcggguggaccggcaugaucgacgggugguacggcuaccaccaccagaacgagcaggggucgggcuacgccgccgaccggaaguccacccagaacgcgaucgacgggaucaccaacaaggucaacagcgugaucgagaagaugaacacgcaguucaccgccgugggcaaggaguucaaccaccuggagaagcgcaucgagaaccugaacaagaaggucgacgacggccuccuggacguguggaccuacaacgccgagcugcucguccugcuggagaacgagcggacccucgacuaccacgacuccaacgugaagaaccuguacgagaaggugcgcucgcagcugaagaacaacgccaaggagaucgggaacggcugcuucgaguucuaccacaagugcgacgacacgugcauggaguccguccggaacggggccuacgacuaccccaaguacagcgaggaggcgaagcucaaccgcgaggagaucgacggcgugaagcuggaguccacccggaucuaccagauccuggccaucuacucgaccguggccuccagccucguccugcuggugucccucggggccaucucguucuggaugugcagcaacggcucccugcagugccgcaucugcaucuga

SEQ ID NO: 4394 - RNA, 1701 nt, Artificial Sequence
  derived and/or modified CDS sequence (AUadapt) from InfluenzaA__ADD21457__HA
augaaggccauccugguguuccuccuguacaccuucgccaccgcgaacgccgacacgcugugcaucggcuaccacgccaacaacucgaccgacaccgucgacaccgugcucgagaagaacgugacggucacccacuccgugaaccugcuggaggaccgccacaacgggaagcucugcaagcugcggggcguggcgccccugcaccucgggaagugcaacaucgccggcuggcugcuggggaacccggagugcgagcuccuguucaccgccucguccuggagcuacaucgucgagaccuccaacucggacaacggcacgugcuaccccggcgacuucaucaacuacgaggagcugcgcgagcagcucuccagcguguccucguucgagcgguucgagauguuccccaaguccagcuccuggcccaaccacgagaccaaccgcggggugaccgccgccugcccguacgccggcgcgaacucguucuaccggaaccugaucuggcuggucaagaaggagaacuccuaccccaagcucagcaaguccuacaucaacaacaaggagaaggaggugcuggugcugugggggauccaccacccgcccaccucggccgaccagcagucccucuaccagaacgccgacgccuacgucuucgugggcagcucgaaguacaacaagaaguuccgccccgagaucgccgcgcggcccaaggugcgcgggcagacgggccggaugaacuacuacuggacccuggucgagcccggcgacaccaucaccuucgaggccacggggaaccugguggugccccgcuacgccuucgccaugaagcggggcuccgggagcggcaucaucaucuccgacaccccgguccacgacugcaacacgaccugccagacccccaagggcgccgugaacaccucgcuccccuuccagaacauccaccccgugaccaucggggagugcccgaaguacgucaaguccaccaaccugcgcauggcgacgggccugcggaacauccccagcauccagucccgcggccucuucggggccaucgccggguucaucgagggcggcuggaccgggaugaucgacggcugguacggguaccaccaccagaacgagcagggcucgggguacgccgccgaccggaaguccacccagaacgcgaucgacggcaucaccaacaaggugaacagcgugaucgagaagaugaacacgcaguucaccgccgucggcaaggaguucaaccaccuggagaagcgcaucgagaaccugaacaagaagguggacgacgggcuccuggacgucuggaccuacaacgccgagcugcucgugcugcuggagaacgagcggacccucgacuaccacgacuccaacgugaagaaccuguacgagaagguccgcucgcagcugaagaacaacgccaaggagaucggcaacgggugcuucgaguucuaccacaagugcgacgacacgugcauggaguccgugcggaacggcaccuacgacuaccccaaguacagcgaggaggccaagcucaaccgcgaggagaucgacggggugaagcuggaguccacccggaucuaccagauccuggcgaucuacucgaccgucgccuccagccucgugcugcuggugucccucggcgccaucucguucuggaugugcagcaacggcucccugcagugccgcaucugcaucuga

SEQ ID NO: 4395 - RNA, 1698 nt, Artificial Sequence
  derived and/or modified CDS sequence (AUadapt) from InfluenzaA__ADD21467__HA
augaaggccaagcugcucgugcugcugugcaccuucaccgccacguacgcggacaccaucugcaucggcuaccacgccaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggucguacaucgucgagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgugaccggggucuccgccucgugcucccacaacggcaagagcuccuucuaccgcaaccugcuguggcucaccgggaagaacggccuguaccccaaccugagcaaguccuacgccaacaacaaggagaaggaggugcucgugcuguggggcguccaccacccgcccaacauccgggaccagcgcgcccuguaccacacggagaacgccuacgugucgguggucagcucccacuacagccggcgcuucacccccgagaucgcgaagcggcccaaggugcgcgggcaggagggccggaucaacuacuacuggacccuccuggagcccggggacaccaucaucuucgaggccaacggcaaccugaucgccccgugguacgccuucgcccucucccgcggguucggcagcggcaucaucacguccaacgcgcccauggacgagugcgacgccaagugccagacgccccagggggccaucaacucgucccugcccuuccagaacgugcacccggucaccaucggcgagugccccaaguacgcccggagcgccaagcugcgcauggugaccgggcuccggaacauccccuccauccagagccgcggccuguucggggcgaucgccggcuucaucgagggcggguggaccggcaugguggacgggugguacggcuaccaccaccagaacgagcagggguccggcuacgccgccgaccagaaguccacccagaacgccaucaacggcaucaccaacaaggucaacucggugaucgagaagaugaacacccaguucacggcgguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacgucaagaaccuguacgagaaggugaagucccagcugaagaacaacgccaaggagaucgggaacggcugcuucgaguucuaccacaagugcaacaacgagugcauggagagcgugaagaacgggaccuacgacuaccccaaguacuccgaggagagcaagcucaaccgcgagaagaucgacggcgucaagcuggaguccaugggcguguaccagauccuggccaucuacucgacgguggccagcucccucguccugcuggugagccucggggcgaucuccuucuggaugugcagcaacggcucccugcagugccggaucugcaucuga

SEQ ID NO: 4396 - RNA, 1701 nt, Artificial Sequence
  derived and/or modified CDS sequence (AUadapt) from InfluenzaA__ADD21560__HA
augaagaccaucaucgccuucucgcacauccugugccucaucuacgcccagaagcugcccggcuccgacaacagcauggcgacccugugccucgggcaccacgccgugccgaacggcacgcuggucaagaccaucaccgacgaccagaucgaggugaccaacgccacggagcuggugcaguccucguccaccgggcgcaucugcaacagcccccaccacauccucgacggcaagaacugcacccugaucgacgcccugcucggggacccccacugcgacgacuuccagaacaaggagugggaccuguucgucgagcgguccaccgccuacagcaacugcuaccccuacuacgugccggacuacgcgucccugcgcucgcucguggccuccagcggcacgcuggaguucacccaggaguccuucaacuggaccggcgucacccaggacgggucguccuacacgugccggcgcaagagcgugaacuccuucuucagccggcugaacuggcuccacaaccuggacuacaaguaccccgcccugaacgugaccaugcccaacaacgacaaguucgacaagcucuacaucuggggcguccaccaccccgggaccgaccgcgaccagaccaaccuguacgugcaggccuccggccgggugacggucucgaccaagcgcagccagcagaccgugaucccgaacaucgggucccggcccugggugcgcggcgucucguccaucaucagcaucuacuggaccaucgugaagcccggcgacauccugcucaucaacuccacggggaaccugaucgcgccccggggcuacuucaagauccagagcgggaaguccucgaucaugcgcuccgacgccccgaucggcaacugcaacagcgagugcaucacccccaacggcuccauccccaacgacaagcccuuccagaacgugaaccggaucaccuacggggccugcccgcgcuacgucaagcagaacacccugaagcucgccacgggcaugcggaacgugcccgagaagcagacccgcgggaucuucggcgccaucgcgggguucaucgagaacggcugggagggcaugguggacgggugguacggcuuccggcaccagaacucggaggggaccggccaggccgccgaccugaaguccacccaggccgccaucaaccagaucacggggaagcugaaccgcgucaucaagaagaccaacgagaaguuccaccagaucgagaaggaguucagcgagguggagggccggauccaggaccucgagaaguacguggaggacaccaagaucgaccugugguccuacaacgcggagcugcucgucgcccuggagaaccagcacaccaucgaccugacggacagcgagaugaacaagcuguucgagcgcacccggaagcagcuccgcgagaacgccgaggacaugggcaacgggugcuucaagaucuaccacaagugcgacaacgccugcaucggcuccauccgcaacgggaccuacgaccacgacguguaccgggacgaggcccugaacaaccgcuuccagaucaagucgguccagcucaaguccggcuacaaggacuggauccuguggaucagcuucgcgaugagcugcuuccugcucugcguggugcugcugggguucaucauguggaccugccagaagggcaacaucaagugcaacaucugcaucuga

SEQ ID NO: 4397 - RNA, 1701 nt, Artificial Sequence; identical to SEQ ID NO: 62
  derived and/or modified CDS sequence (AUadapt) from InfluenzaA__ADD21734__HA

SEQ ID NO: 4398 - RNA, 1701 nt, Artificial Sequence; identical to SEQ ID NO: 116
  derived and/or modified CDS sequence (AUadapt) from InfluenzaA__ADD21744__HA

SEQ ID NO: 4399 - RNA, 1701 nt, Artificial Sequence
  derived and/or modified CDS sequence (AUadapt) from InfluenzaA__ADD21764__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgaguccgggaucaucaucagcgacacgcccgugcacgacugcaacacgaccugccagaccccgaagggcgccaucaacaccucccugcccuuccagaacauccaccccaucaccaucggcaagugccccaaguacgucaagucgaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagucgacccagaacgcgaucgacgagaucaccaacaaggugaacuccgucaucgagaagaugaacacccaguucacggccguggggaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcucgagagcacccgcaucuaccagauccuggcgaucuacuccaccgucgccucgagccuggugcucguggucucccugggcgccaucucguucuggaugugcuccaacgggagccugcagugccggaucugcaucuga

SEQ ID NO: 4400 - RNA, 1701 nt, Artificial Sequence
  derived and/or modified CDS sequence (AUadapt) from InfluenzaA__ADD21774__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgucggugcagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggucaacucggugaucgagaagaugaacacccaguucaccgccgucggcaaggaguucaaccaccuggagaagcgcaucgagaaccugaacaagaagguggacgacggcuuccucgacaucuggacguacaacgccgagcugcuggugcuccuggagaacgagcggacccuggacuaccacgacuccaacgucaagaaccucuacgagaaggugcgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgucaagcucgaguccacccgcaucuaccagauccuggcgaucuacagcaccguggccucgucccuggugcucgucgugagccugggggccaucuccuucuggaugugcagcaacggcucccugcagugccggaucugcaucuga

SEQ ID NO: 4401 - RNA, 1701 nt, Artificial Sequence; identical to SEQ ID NO: 116
  derived and/or modified CDS sequence (AUadapt) from InfluenzaA__ADD21784__HA

SEQ ID NO: 4402 - RNA, 1701 nt, Artificial Sequence; identical to SEQ ID NO: 4074
  derived and/or modified CDS sequence (AUadapt) from InfluenzaA__ADD21794__HA

SEQ ID NO: 4403 - RNA, 1701 nt, Artificial Sequence; identical to SEQ ID NO: 116
  derived and/or modified CDS sequence (AUadapt) from InfluenzaA__ADD21804__HA

SEQ ID NO: 4404 - RNA, 1701 nt, Artificial Sequence
  derived and/or modified CDS sequence (AUadapt) from InfluenzaA__ADD21814__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccagcuggauccugggcaacccggagugcgagucccugucgaccgcguccagcugguccuacaucguggagaccucguccagcgacaacgggacgugcuaccccggcgacuucaucgacuacgaggagcuccgggagcagcuguccucgguguccagcuucgagcgcuucgagaucuuccccaagaccuccucguggcccaaccacgacuccaacaagggcgucaccgccgccugcccgcacgccggggccaagagcuucuacaagaaccugaucuggcucgugaagaagggcaacuccuaccccaagcugucgaagagcuacaucaacgacaaggggaaggaggugcugguccucuggggcauccaccaccccuccaccucggccgaccagcagucccuguaccagaacgccgacgccuacguguucguggggacgagccgguacuccaagaaguucaagcccgagaucgccauccgcccgaagguccgggaccaggagggccgcaugaacuacuacuggacccugguggagcccggcgacaagaucaccuucgaggcgaccgggaaccucguggucccccgguacgccuucgccauggagcgcaacgccggcucggggaucaucaucuccgacacgcccgugcacgacugcaacacgaccugccagaccccgaagggcgccaucaacaccagccugcccuuccagaacauccaccccaucaccaucggcaagugccccaaguacgugaaguccaccaagcugcggcucgcgaccgggcugcgcaacgucccgucgauccagucccggggccuguucggggccaucgccggcuucaucgagggcggguggacgggcaugguggacgggugguacggcuaccaccaccagaacgagcaggggagcggcuacgccgccgaccucaaguccacccagaacgcgaucgacgagaucaccaacaaggugaacucggucaucgagaagaugaacacccaguucacggccguggggaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucggcaacgggugcuucgaguucuaccacaagugcgacaacacgugcauggaguccgugaagaacggcaccuacgacuaccccaaguacucggaggaggccaagcugaaccgggaggagaucgacggggugaagcucgaguccacccgcaucuaccagauccuggcgaucuacagcaccgucgccucgucccuggugcucguggucagccugggcgccaucuccuucuggaugugcagcaacgggucccugcagugccggaucugcaucuga

SEQ ID NO: 4405 - RNA, 1701 nt, Artificial Sequence; identical to SEQ ID NO: 4074
  derived and/or modified CDS sequence (AUadapt) from InfluenzaA__ADD21824__HA

SEQ ID NO: 4406 - RNA, 1701 nt, Artificial Sequence; identical to SEQ ID NO: 4074
  derived and/or modified CDS sequence (AUadapt) from InfluenzaA__ADD21834__HA

SEQ ID NO: 4407 - RNA, 1701 nt, Artificial Sequence; identical to SEQ ID NO: 4078
  derived and/or modified CDS sequence (AUadapt) from InfluenzaA__ADD21844__HA

SEQ ID NO: 4408 - RNA, 1701 nt, Artificial Sequence; identical to SEQ ID NO: 4078
  derived and/or modified CDS sequence (AUadapt) from InfluenzaA__ADD21854__HA

SEQ ID NO: 4409 - RNA, 1701 nt, Artificial Sequence; identical to SEQ ID NO: 4016
  derived and/or modified CDS sequence (AUadapt) from InfluenzaA__ADD21864__HA

SEQ ID NO: 4410 - RNA, 1701 nt, Artificial Sequence
  derived and/or modified CDS sequence (AUadapt) from InfluenzaA__ADD21884__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccggcaacggcacgugcuaccccggggacuucaucgacuacgaggagcuccgggagcagcugucguccgugagcuccuucgagcgcuucgagaucuuccccaagaccucguccuggcccaaccacgacagcaacaagggcgucaccgccgccugcccgcacgccggggcgaaguccuucuacaagaaccugaucuggcucgugaagaagggcaacucguaccccaagcuguccaagagcuacaucaacgacaaggggaaggaggugcugguccucuggggcauccaccaccccucgaccuccgccgaccagcagagccuguaccagaacgccgacgccuacguguucgugggcacgucccgguacucgaagaaguucaagcccgagaucgccauccgcccgaagguccgggaccaggaggggcgcaugaacuacuacuggacccugguggagcccggcgacaagaucaccuucgaggcgaccgggaaccucguggucccccgguacgccuucgccauggagcgcaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagucgaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcaugggcucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggcgccaucucguucuggaugugcuccaacgggagccugcagugccggaucugcaucuga

SEQ ID NO: 4411 - RNA, 1701 nt, Artificial Sequence; identical to SEQ ID NO: 4016
  derived and/or modified CDS sequence (AUadapt) from InfluenzaA__ADD21894__HA

SEQ ID NO: 4412 - RNA, 1701 nt, Artificial Sequence
  derived and/or modified CDS sequence (AUadapt) from InfluenzaA__ADD22501__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacguccaaguacagcaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagucgcgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcggaucgagaaccugaacaagaagaucgacgacggcuuccucgacaucuggaccuacaacgccgagcugcugguccuccuggagaacgagcgcacccuggacuaccacgacucgaacgugaagaaccucuacgagaaggugcggauccagcugaagaacaacgccaaggagaucgggaacggcugcuucgaguucuaccacaagugcgacaacacgugcauggaguccgucaagaacgggaccuacgacuaccccaaguacagcgaggaggccaagcugaaccgcgaggagaucgacggcgugaagcucgaguccacccggaucuaccagauccuggcgaucuacucgaccguggccuccagccugguccucguggugucgcugggggccaucuccuucuggaugugcagcaacggcucccugcagugccgcaucugcaucuga

SEQ ID NO: 4413 - RNA, 1701 nt, Artificial Sequence; identical to SEQ ID NO: 4016
  derived and/or modified CDS sequence (AUadapt) from InfluenzaA__ADD22511__HA

SEQ ID NO: 4414 - RNA, 1701 nt, Artificial Sequence
  derived and/or modified CDS sequence (AUadapt) from InfluenzaA__ADD22521__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacacguacguguucgugggcaccucccgguacucgaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacgagaucaccaacaaggugaacuccgucaucgagaagaugaacacgcaguucaccgcggugggcaaggaguucaaccaccuggagaagcgcaucgagaaccugaacaagaagaucgacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggccaucuacuccaccguggcgucgagccugguccucguggugucccugggggccaucucguucuggaugugcuccaacggcagccugcagugccggaucugcaucuga

SEQ ID NO: 4415 - RNA, 1701 nt, Artificial Sequence; identical to SEQ ID NO: 116
  derived and/or modified CDS sequence (AUadapt) from InfluenzaA__ADD22531__HA

SEQ ID NO: 4416 - RNA, 1701 nt, Artificial Sequence
  derived and/or modified CDS sequence (AUadapt) from InfluenzaA__ADD22541__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccggcaacggcacgugcuaccccggggacuucaucgacuacgaggagcuccgggagcagcugucguccgugagcuccuucgagcgcuucgagaucuuccccaagaccucguccuggcccaaccacgacagcaacaagggcgucaccgccgccugcccgcacgccggggcgaaguccuucuacaagaaccugaucuggcucgugaagaagggcaacucguaccccaagcuguccaagagcuacaucaacgacaaggggaaggaggugcugguccucuggggcauccaccaccccucgaccuccgccgaccagcagagccuguaccagaacgccgacgccuacguguucgugggcacguccaaguacucgaagaaguucaagcccgagaucgccauccggccgaagguccgcgaccaggaggggcggaugaacuacuacuggacccugguggagcccggcgacaagaucaccuucgaggcgaccgggaaccucguggucccccgcuacgccuucgccauggagcggaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagucgaccaagcugcgccucgcgaccgggcugcggaacgugccguccauccagagccgcggccuguucggggccaucgccggcuucaucgagggcggguggacgggcaugguggacgggugguacggcuaccaccaccagaacgagcagggguccggcuacgccgccgaccucaagucgacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggguuccucgacaucuggaccuacaacgccgagcugcuggugcuccuggagaacgagcgcacccuggacuaccacgacagcaacgugaagaaccucuacgagaagguccggucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgcgaggagaucgacggggugaagcucgagagcacccggaucuaccagauccuggcgaucuacuccaccgucgccucgagccuggugcucguggucucccugggcgccaucucguucuggaugugcuccaacggcagccugcagugccgcaucugcaucuga

SEQ ID NO: 4417 - RNA, 1701 nt, Artificial Sequence; identical to SEQ ID NO: 4016
  derived and/or modified CDS sequence (AUadapt) from InfluenzaA__ADD22554__HA

SEQ ID NO: 4418 - RNA, 1701 nt, Artificial Sequence; identical to SEQ ID NO: 4016
  derived and/or modified CDS sequence (AUadapt) from InfluenzaA__ADD22564__HA

SEQ ID NO: 4419 - RNA, 1701 nt, Artificial Sequence
  derived and/or modified CDS sequence (AUadapt) from InfluenzaA__ADD22574__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacacguacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucucggacacccccgugcacgacugcaacacgaccugccagacccugaagggcgccaucaacaccucccugccguuccagaacauccaccccaucaccaucgggaagugccccaaguacgucaagagcaccaagcuccggcuggccacgggccugcgcaacgugcccuccauccagucgcgggggcuguucggcgcgaucgccggguucaucgagggcggcuggaccgggaugguggacggcugguacggguaccaccaccagaacgagcagggcuccggguacgccgccgaccucaagagcacccagaacgccaucgacgagaucaccaacaaggugaacuccgucaucgagaagaugaacacgcaguucaccgcggugggcaaggaguucaaccaccuggagaagcgcaucgagaaccucaacaagaagaucgacgacggcuuccuggacaucuggaccuacaacgccgagcugcucguccugcuggagaacgagcggacccucgacuaccacgacucgaacgugaagaaccuguacgagaaggugcgcucccagcugaagaacaacgccaaggagaucgggaacggcugcuucgaguucuaccacaagugcgacaacacgugcauggagagcgucaagaacgggaccuacgacuacccgaaguacuccgaggaggccaagcucaaccgggaggagaucgacggcgugaagcuggagucgacccgcaucuaccagauccuggccaucuacuccaccguggcgagcucgcucguccugguggugucccugggggccaucagcuucuggaugugcuccaacggcagccuccagugccggaucugcaucuga

SEQ ID NO: 4420 - RNA, 1701 nt, Artificial Sequence; identical to SEQ ID NO: 4016
  derived and/or modified CDS sequence (AUadapt) from InfluenzaA__ADD22584__HA

SEQ ID NO: 4421 - RNA, 1701 nt, Artificial Sequence; identical to SEQ ID NO: 116
  derived and/or modified CDS sequence (AUadapt) from InfluenzaA__ADD22594__HA

SEQ ID NO: 4422 - RNA, 1701 nt, Artificial Sequence; identical to SEQ ID NO: 4016
  derived and/or modified CDS sequence (AUadapt) from InfluenzaA__ADD22604__HA

SEQ ID NO: 4423 - RNA, 1701 nt, Artificial Sequence; identical to SEQ ID NO: 4016
  derived and/or modified CDS sequence (AUadapt) from InfluenzaA__ADD22614__HA

SEQ ID NO: 4424 - RNA, 1701 nt, Artificial Sequence; identical to SEQ ID NO: 4016
  derived and/or modified CDS sequence (AUadapt) from InfluenzaA__ADD22624__HA

SEQ ID NO: 4425 - RNA, 1701 nt, Artificial Sequence
  derived and/or modified CDS sequence (AUadapt) from InfluenzaA__ADD22634__HA
augaaggccauccuggugguccuccugugcaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaagaucgacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgagccugguccucguggugucccugggggccaucucguucuggaugugcuccaacggcagccugcagugccggaucugcaucuga

SEQ ID NO: 4426 - RNA, 1701 nt, Artificial Sequence
  derived and/or modified CDS sequence (AUadapt) from InfluenzaA__ADD22645__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccggcaacggcacgugcuaccccggggacuucaucgacuacgaggagcuccgggagcagcugucguccgugagcuccuucgagcgcuucgagaucuuccccaagaccucguccuggcccaaccacgacagcaacaagggcgucaccgccgccugcccgcacgccggggcgaaguccuucuacaagaaccugaucuggcucgugaagaagggcaacucguaccccaagcuguccaagagcuacaucaacgacaaggggaaggaggugcugguccucuggggcauccaccaccccucgaccuccgccgaccagcagagccuguaccagaacgccgacgccuacguguucgugggcacgucccgguacucgaagaaguucaagcccgagaucgccauccgcccgaagguccgggaccaggaggggcgcaugaacuacuacuggacccugguggagcccggcgacaagaucaccuucgaggcgaccgggaaccucguggucccccgguacgccuucgccauggagcgcaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagucgaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgagggggugaagcucgagagcacccgcaucuaccagauccuggcgaucuacuccaccgucgccucgagccuggugcucguggucucccugggcgccaucucguucuggaugugcuccaacggcagccugcagugccggaucugcaucuga

SEQ ID NO: 4427 - RNA, 1701 nt, Artificial Sequence
  derived and/or modified CDS sequence (AUadapt) from InfluenzaA__ADD22665__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccggcaacggcacgugcuaccccggggacuucaucgacuacgaggagcuccgggagcagcugucguccgugagcuccuucgagcgcuucgagaucuuccccaagaccucguccuggcccaaccacgacagcaacaagggcgucaccgccgccugcccgcacgccggggcgaaguccuucuacaagaaccugaucuggcucgugaagaagggcaacucguaccccaagcuguccaagagcuacaucaacgacaagcggaaggaggugcugguccucugggggauccaccaccccucgaccuccgccgaccagcagagccuguaccagaacgccgacgccuacguguucgugggcacguccaaguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 4428 - RNA, 1701 nt, Artificial Sequence; identical to SEQ ID NO: 4016
  derived and/or modified CDS sequence (AUadapt) from InfluenzaA__ADD22675__HA

SEQ ID NO: 4429 - RNA, 1701 nt, Artificial Sequence; identical to SEQ ID NO: 4016
  derived and/or modified CDS sequence (AUadapt) from InfluenzaA__ADD22685__HA

SEQ ID NO: 4430 - RNA, 1701 nt, Artificial Sequence; identical to SEQ ID NO: 4016
  derived and/or modified CDS sequence (AUadapt) from InfluenzaA__ADD22695__HA

SEQ ID NO: 4431 - RNA, 1701 nt, Artificial Sequence
  derived and/or modified CDS sequence (AUadapt) from InfluenzaA__ADD22722__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggaccgccacaacgggaagcucugcaagcugcggggcgucgcgccccugcaccucgggaagugcaacaucgccggcuggauccuggggaacccggagugcgagagccuguccaccgccucguccuggagcuacaucguggagaccuccucguccggcaacggcacgugcuaccccggggacuucaucgacuacgaggagcuccgcgagcagcugagcuccgugucguccuucgagcgguucgagaucuuccccaagaccagcuccuggcccaaccacgacucgaacaagggcgucaccgccgccugcccgcacgccggggcgaaguccuucuacaagaaccugaucuggcucgugaagaagggcaacagcuaccccaagcuguccaagucguacaucaacgacaaggggaaggaggugcugguccucuggggcauccaccaccccagcaccuccgccgaccagcagucgcuguaccagaacgccgacgccuacguguucgugggcacguccagcuacuccaagaaguucaagcccgagaucgccauccgcccgaagguccgggaccaggaggggcgcaugaacuacuacuggacccugguggagcccggcgacaagaucaccuucgaggcgaccgggaaccucguggucccccgguacgccuucgccauggagcgcaacgccggcucgggcaucaucaucuccgacacgcccgugcacgacugcaacacgaccugccagaccccgaagggggccaucaacaccagccugcccuuccagaacauccaccccaucaccaucggcaagugccccaaguacgugaaguccaccaagcugcggcucgcgaccgggcugcgcaacgucccgucgauccagucccggggccuguucggggccaucgccggcuucaucgagggcggguggacgggcaugguggacgggugguacggcuaccaccaccagaacgagcaggggagcggcuacgccgccgaccucaaguccacccagaacgcgaucgacgagaucaccaacaaggugaacucggucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacuccaacgugaagaaccucuacgagaagguccgcagccagcugaagaacaacgccaaggagaucggcaacgggugcuucgaguucuaccacaagugcgacaacacgugcauggaguccgugaagaacggcaccuacgacuaccccaaguacucggaggaggccaagcugaaccgggaggagaucgacggggugaagcucgaguccacccgcaucuaccagauccuggcgaucuacagcaccgucgccucgucccuggugcucguggucagccugggcgccaucuccuucuggaugugcagcaacggcucccugcagugccggaucugcaucuga

SEQ ID NO: 4432 - RNA, 1701 nt, Artificial Sequence; identical to SEQ ID NO: 4414
  derived and/or modified CDS sequence (AUadapt) from InfluenzaA__ADD22732__HA

SEQ ID NO: 4433 - RNA, 1701 nt, Artificial Sequence
  derived and/or modified CDS sequence (AUadapt) from InfluenzaA__ADD22742__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccggcaacggcacgugcuaccccggggacuucaucgacuacgaggagcuccgggagcagcugagcuccgugucguccuucgagcgcuucgagaucuuccccaagaccagcuccuggcccaaccacgacucgaacaagggcgucaccgccgccugcccgcacgccggggcgaaguccuucuacaagaaccugaucuggcucgugaagaagggcaacagcuaccccaagcuguccaagucguacaucaacgacaaggggaaggaggugcugguccucuggggcauccaccaccccagcaccuccgccgaccagcagucgcuguaccagaacgccgacgccuacguguucgugggcacguccagcuacuccaagaaguucaagcccgagaucgccauccggccgaagguccgcgaccaggaggggcggaugaacuacuacuggacccugguggagcccggcgacaagaucaccuucgaggcgaccgggaaccucguggucccccgcuacgccuucgccauggagcggaacgccggcucgggcaucaucaucuccgacacgcccgugcacgacugcaacacgaccugccagaccccgaagggggccaucaacaccagccugcccuuccagaacauccaccccaucaccaucggcaagugccccaaguacgugaaguccaccaagcugcgccucgcgaccgggcugcggaacgucccgucgauccagucccgcggccuguucggggccaucgccggcuucaucgagggcggguggacgggcaugguggacgggugguacggcuaccaccaccagaacgagcaggggagcggcuacgccgccgaccucaaguccacccagaacgcgaucgacgagaucaccaacaaggugaacucggucaucgagaagaugaacacccaguucacggccgugggcaaggaguucaaccaccuggagaagcggaucgagaaccugaacaagaaggucgacgacggguuccucgacaucuggaccuacaacgccgagcugcuggugcuccuggagaacgagcgcacccuggacuaccacgacuccaacgugaagaaccucuacgagaagguccggagccagcugaagaacaacgccaaggagaucggcaacgggugcuucgaguucuaccacaagugcgacaacacgugcauggaguccgugaagaacggcaccuacgacuaccccaaguacucggaggaggccaagcugaaccgcgaggagaucgacggggugaagcucgaguccacccggaucuaccagauccuggcgaucuacagcaccgucgccucgucccuggugcucguggucagccugggcgccaucuccuucuggaugugcagcaacggcucccugcagugccgcaucugcaucuga

SEQ ID NO: 4434 - RNA, 1701 nt, Artificial Sequence; identical to SEQ ID NO: 116
  derived and/or modified CDS sequence (AUadapt) from InfluenzaA__ADD22752__HA

SEQ ID NO: 4435 - RNA, 1701 nt, Artificial Sequence; identical to SEQ ID NO: 3005
  derived and/or modified CDS sequence (AUadapt) from InfluenzaA__ADD22762__HA

SEQ ID NO: 4436 - RNA, 1701 nt, Artificial Sequence; identical to SEQ ID NO: 4016
  derived and/or modified CDS sequence (AUadapt) from InfluenzaA__ADD22772__HA

SEQ ID NO: 4437 - RNA, 1701 nt, Artificial Sequence; identical to SEQ ID NO: 4016
  derived and/or modified CDS sequence (AUadapt) from InfluenzaA__ADD22782__HA

SEQ ID NO: 4438 - RNA, 1701 nt, Artificial Sequence
  derived and/or modified CDS sequence (AUadapt) from InfluenzaA__ADD22792__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccggcaacggcacgugcuaccccggggacuucaucaacuacgaggagcuccgggagcagcugucguccgugagcuccuucgagcgcuucgagaucuuccccaagaccucguccuggcccaaccacgacagcaacaagggcgucaccgccgccugcccgcacgccggggcgaaguccuucuacaagaaccugaucuggcucgugaagaagggcaacucguaccccaagcuguccaagagcuacaucaacgacaaggggaaggaggugcugguccucuggggcauccaccaccccucgaccuccgccgaccagcagagccuguaccagaacgccgacgccuacguguucgugggcacgucccgguacucgaagaaguucaagcccgagaucgccauccgcccgaagguccgggaccaggaggggcgcaugaacuacuacuggacccugguggagcccggcgacaagaucaccuucgaggcgaccgggaaccucguggucccccgguacgccuucgccauggagcgcaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagucgaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcucgagagcacccgcaucuaccagauccuggcgaucuacuccaccgucgccucgagccuggugcucguggucucccugggcgccaucucguucuggaugugcuccaacggcagccugcagugccggaucugcaucuga

SEQ ID NO: 4439 - RNA, 1701 nt, Artificial Sequence; identical to SEQ ID NO: 4414
  derived and/or modified CDS sequence (AUadapt) from InfluenzaA__ADD22802__HA

SEQ ID NO: 4440 - RNA, 1701 nt, Artificial Sequence; identical to SEQ ID NO: 4016
  derived and/or modified CDS sequence (AUadapt) from InfluenzaA__ADD22812__HA

SEQ ID NO: 4441 - RNA, 1701 nt, Artificial Sequence
  derived and/or modified CDS sequence (AUadapt) from InfluenzaA__ADD22822__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucggccgacaacggcacgugcuaccccggcgacuucaucgacuacgaggagcuccgggagcagcuguccagcguguccucguucgagcgcuucgagaucuuccccaagaccuccagcuggcccaaccacgacuccaacaagggggucaccgccgccugcccgcacgcgggcgccaagucguucuacaagaaccugaucuggcucgugaagaaggggaacuccuaccccaagcugagcaaguccuacaucaacgacaagggcaaggaggugcugguccucugggggauccaccaccccucgaccagcgccgaccagcagucccuguaccagaacgccgacgccuacguguucgugggcacgucgaaguacuccaagaaguucaagcccgagaucgcgauccggccgaagguccgcgaccaggagggccggaugaacuacuacuggacccugguggagcccggggacaagaucaccuucgaggccaccggcaaccucguggucccccgcuacgccuucgccauggagcggaacgccgggagcggcaucaucaucuccgacacgcccgugcacgacugcaacacgaccugccagaccccgaagggcgcgaucaacaccucgcugcccuuccagaacauccaccccaucaccaucgggaagugccccaaguacgugaaguccaccaagcugcgccucgccaccggccugcggaacgucccgagcauccagucccgcgggcuguucggcgccaucgccggguucaucgagggcggcuggacggggaugguggacggcugguacggguaccaccaccagaacgagcagggcucgggguacgccgcggaccucaaguccacccagaacgccaucgacgagaucaccaacaaggugaacagcgucaucgagaagaugaacacccaguucacggccgugggcaaggaguucaaccaccuggagaagcggaucgagaaccugaacaagaagaucgacgacggcuuccucgacaucuggaccuacaacgccgagcugcugguccuccuggagaacgagcgcacccuggacuaccacgacuccaacgugaagaaccucuacgagaaggugcggucgcagcugaagaacaacgccaaggagaucgggaacggcugcuucgaguucuaccacaagugcgacaacaugugcauggaguccgucaagaacgggaccuacgacuaccccaaguacagcgaggaggcgaagcugaaccgcgaggagaucgacggcgugaagcucgaguccacgcggaucuaccagauccuggccaucuacucgaccguggccuccagccugguccucguggugucgcugggggccaucuccuucuggaugugcagcaacggcucccugcagugccgcaucugcaucuga

SEQ ID NO: 4442 - RNA, 1701 nt, Artificial Sequence; identical to SEQ ID NO: 4016
  derived and/or modified CDS sequence (AUadapt) from InfluenzaA__ADD22832__HA

SEQ ID NO: 4443 - RNA, 1701 nt, Artificial Sequence; identical to SEQ ID NO: 4016
  derived and/or modified CDS sequence (AUadapt) from InfluenzaA__ADD22842__HA

SEQ ID NO: 4444 - RNA, 1701 nt, Artificial Sequence
  derived and/or modified CDS sequence (AUadapt) from InfluenzaA__ADD22852__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucgugaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggucaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgucaagcucgagagcacccgcaucuaccagauccuggcgaucuacuccaccguggccucgagccuggugcucgucgugucccugggggccaucucguucuggaugugcuccaacggcagccugcagugccggaucugcaucuga

SEQ ID NO: 4445 - RNA, 1701 nt, Artificial Sequence
  derived and/or modified CDS sequence (AUadapt) from InfluenzaA__ADD22941__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgaucucgugguccuacaucguggagaccagcuccucgggcaacggcacgugcuaccccggggacuucaucgacuacgaggagcuccgggagcagcuguccagcguguccucguucgagcgcuucgagaucuuccccaagaccuccagcuggcccaaccacgacuccaacaagggcgucaccgccgccugcccgcacgccggggccaagucguucuacaagaaccugaucuggcucgugaagaagggcaacuccuaccccaagcugagcaaguccuacaucaacgacaaggggaaggaggugcugguccucuggggcauccaccaccccucgaccagcgccgaccagcagucccuguaccagaacgccgacgccuacguguucgugggcacgucgcgguacuccaagaaguucaagcccgagaucgccauccgcccgaagguccgggaccaggaggggcgcaugaacuacuacuggacccugguggagcccggcgacaagaucaccuucgaggcgaccgggaaccucguggucccccgguacgccuucgccauggagcgcaacgccggcagcggcaucaucaucuccgacacgcccgugcacgacugcaacacgaccugccagaccccgaagggggccaucaacaccucgcugcccuuccagaacauccaccccaucaccaucggcaagugccccaaguacgugaaguccaccaagcugcggcucgcgaccgggcugcgcaacgucccgagcauccagucccggggccuguucggggccaucgccggcuucaucgagggcggguggacgggcaugguggacgggugguacggcuaccaccaccagaacgagcaggggucgggcuacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcaucuaccagauccuggcgaucuacucgaccgucgccuccagccuggugcucguggucucgcugggcgccaucuccuucuggaugugcagcaacggcucccugcagugccggaucugcaucuga

SEQ ID NO: 4446 - RNA, 1701 nt, Artificial Sequence; identical to SEQ ID NO: 4016
  derived and/or modified CDS sequence (AUadapt) from InfluenzaA__ADD22951__HA

SEQ ID NO: 4447 - RNA, 1701 nt, Artificial Sequence; identical to SEQ ID NO: 4016
  derived and/or modified CDS sequence (AUadapt) from InfluenzaA__ADD22961__HA

SEQ ID NO: 4448 - RNA, 1701 nt, Artificial Sequence; identical to SEQ ID NO: 4016
  derived and/or modified CDS sequence (AUadapt) from InfluenzaA__ADD22971__HA

SEQ ID NO: 4449 - RNA, 1701 nt, Artificial Sequence; identical to SEQ ID NO: 4016
  derived and/or modified CDS sequence (AUadapt) from InfluenzaA__ADD23072__HA

SEQ ID NO: 4450 - RNA, 1701 nt, Artificial Sequence
  derived and/or modified CDS sequence (AUadapt) from InfluenzaA__ADD23082__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccggcaacggcacgugcuaccccggggacuucaucgacuacgaggagcuccgggagcagcugucguccgugagcuccuucgagcgcuucgagaucuuccccaagaccucguccuggcccaaccacgacagcaacaagggcgucaccgccgccugcccgcacgccggggcgaaguccuucuacaagaaccugaucuggcucgugaagaagggcaacucguaccccaagcuguccaagagcuacaucaacgacaaggggaaggaggugcugguccucuggggcauccaccaccccucgaccuccgccgaccagcagagccuguaccagaacgccgacacguacguguucgugggcaccucccgguacucgaagaaguucaagcccgagaucgccauccgcccgaagguccgggaccaggaggggcgcaugaacuacuacuggacccugguggagcccggcgacaagaucaccuucgaggccacggggaaccucguggucccccgguacgcguucgccauggagcgcaacgccggcuccggcaucaucaucagcgacacccccgugcacgacugcaacacgaccugccagaccccgaagggggccaucaacaccucccugcccuuccagaacauccaccccaucaccaucggcaagugccccaaguacgucaagucgaccaagcugcggcucgccacggggcugcgcaacgugccguccauccagagccggggccuguucggggcgaucgccggcuucaucgagggcggguggaccggcaugguggacgggugguacggcuaccaccaccagaacgagcagggguccggcuacgccgccgaccucaagucgacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcucgagagcacccgcaucuaccagauccuggccaucuacuccaccgucgcgucgagccuggugcucguggucucccugggcgccaucucguucuggaugugcuccaacggcagccugcagugccggaucugcaucuga

SEQ ID NO: 4451 - RNA, 1701 nt, Artificial Sequence
  derived and/or modified CDS sequence (AUadapt) from InfluenzaA__ADD23102__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccggcaacggcacgugcuaccccggggacuucaucgacuacgaggagcuccgggagcagcugucguccgugagcuccuucgagaaguucgagaucuuccccaagaccucguccuggcccaaccacgacagcaacaagggcgucaccgccgccugcccgcacgccggggcgaaguccuucuacaagaaccugaucuggcucgugaagaagggcaacucguaccccaagcuguccaagagcuacaucaacgacaaggggaaggaggugcugguccucuggggcauccaccaccccucgaccuccgccgaccagcagagccuguaccagaacgccgacgccuacguguucgugggcacgucccgcuacucgaagaaguucaagcccgagaucgccauccggccgaagguccgcgaccaggaggggcggaugaacuacuacuggacccugguggagcccggcgacaagaucaccuucgaggcgaccgggaaccucguggucccccgcuacgccuucgccauggagcggaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagucgaccaagcugcgccucgcgaccgggcugcggaacgugccguccauccagagccgcggccuguucggggccaucgccggcuucaucgagggcggguggacgggcaugguggacgggugguacggcuaccaccaccagaacgagcagggguccggcuacgccgccgaccucaagucgacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggguuccucgacaucuggaccuacaacgccgagcugcuggugcuccuggagaacgagcgcacccuggacuaccacgacagcaacgugaagaaccucuacgagaagguccggucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgcgaggagaucgacggggugaagcucgagagcacccggaucuaccagauccuggcgaucuacuccaccgucgccucgagccuggugcucguggucucccugggcgccaucucguucuggaugugcuccaacggcagccugcagugccgcaucugcaucuga

SEQ ID NO: 4452 - RNA, 1701 nt, Artificial Sequence; identical to SEQ ID NO: 4016
  derived and/or modified CDS sequence (AUadapt) from InfluenzaA__ADD23112__HA

SEQ ID NO: 4453 - RNA, 1701 nt, Artificial Sequence; identical to SEQ ID NO: 4016
  derived and/or modified CDS sequence (AUadapt) from InfluenzaA__ADD23122__HA

SEQ ID NO: 4454 - RNA, 1701 nt, Artificial Sequence; identical to SEQ ID NO: 116
  derived and/or modified CDS sequence (AUadapt) from InfluenzaA__ADD23132__HA

SEQ ID NO: 4455 - RNA, 1701 nt, Artificial Sequence; identical to SEQ ID NO: 4078
  derived and/or modified CDS sequence (AUadapt) from InfluenzaA__ADD23142__HA

SEQ ID NO: 4456 - RNA, 1701 nt, Artificial Sequence
  derived and/or modified CDS sequence (AUadapt) from InfluenzaA__ADD23162__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagggccuguaccagaacgccgacgccuacguguucgugggcacgucgcgguacuccaagaaguucaagcccgagaucgccauccgcccgaagguccgggaccaggaggggcgcaugaacuacuacuggacccugguggagcccggcgacaagaucaccuucgaggcgaccgggaaccucguggucccccgguacgccuucgccauggagcgcaacgccggcagcggcaucaucaucuccgacacgcccgugcacgacugcaacacgaccugccagaccccgaagggggccaucaacaccucgcugcccuuccagaacauccaccccaucaccaucggcaagugccccaaguacgugaaguccaccaagcugcggcucgcgaccgggcugcgcaacgucccgagcauccagucccggggccuguucggggccaucgccggcuucaucgagggcggguggacgggcaugguggacgggugguacggcuaccaccaccagaacgagcaggggucgggcuacgccgccgaccucaaguccacccagaacgcgaucgacaagaucaccaacaaggugaacagcgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcaucuaccagauccuggcgaucuacucgaccgucgccuccagccuggugcucguggucucgcugggcgccaucuccuucuggaugugcagcaacggcucccugcagugccggaucugcaucuga

SEQ ID NO: 4457 - RNA, 1701 nt, Artificial Sequence; identical to SEQ ID NO: 4078
  derived and/or modified CDS sequence (AUadapt) from InfluenzaA__ADD23172__HA

SEQ ID NO: 4458 - RNA, 1701 nt, Artificial Sequence; identical to SEQ ID NO: 4078
  derived and/or modified CDS sequence (AUadapt) from InfluenzaA__ADD23182__HA

SEQ ID NO: 4459 - RNA, 1701 nt, Artificial Sequence; identical to SEQ ID NO: 4078
  derived and/or modified CDS sequence (AUadapt) from InfluenzaA__ADD23192__HA

SEQ ID NO: 4460 - RNA, 1701 nt, Artificial Sequence; identical to SEQ ID NO: 4078
  derived and/or modified CDS sequence (AUadapt) from InfluenzaA__ADD23202__HA

SEQ ID NO: 4461 - RNA, 1701 nt, Artificial Sequence; identical to SEQ ID NO: 4078
  derived and/or modified CDS sequence (AUadapt) from InfluenzaA__ADD23220__HA

SEQ ID NO: 4462 - RNA, 1701 nt, Artificial Sequence; identical to SEQ ID NO: 4074
  derived and/or modified CDS sequence (AUadapt) from InfluenzaA__ADD23230__HA

SEQ ID NO: 4463 - RNA, 1701 nt, Artificial Sequence; identical to SEQ ID NO: 4078
  derived and/or modified CDS sequence (AUadapt) from InfluenzaA__ADD23240__HA

SEQ ID NO: 4464 - RNA, 1701 nt, Artificial Sequence
  derived and/or modified CDS sequence (AUadapt) from InfluenzaA__ADD23260__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccggagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 4465 - RNA, 1701 nt, Artificial Sequence; identical to SEQ ID NO: 3267
  derived and/or modified CDS sequence (AUadapt) from InfluenzaA__ADD23280__HA

SEQ ID NO: 4466 - RNA, 1701 nt, Artificial Sequence
  derived and/or modified CDS sequence (AUadapt) from InfluenzaA__ADD23290__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 4467 - RNA, 1701 nt, Artificial Sequence; identical to SEQ ID NO: 4078
  derived and/or modified CDS sequence (AUadapt) from InfluenzaA__ADD23300__HA

SEQ ID NO: 4468 - RNA, 1701 nt, Artificial Sequence; identical to SEQ ID NO: 4466
  derived and/or modified CDS sequence (AUadapt) from InfluenzaA__ADD23310__HA

SEQ ID NO: 4469 - RNA, 1701 nt, Artificial Sequence; identical to SEQ ID NO: 4078
  derived and/or modified CDS sequence (AUadapt) from InfluenzaA__ADD23320__HA

SEQ ID NO: 4470 - RNA, 1701 nt, Artificial Sequence
  derived and/or modified CDS sequence (AUadapt) from InfluenzaA__ADD23330__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaccaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 4471 - RNA, 1701 nt, Artificial Sequence
  derived and/or modified CDS sequence (AUadapt) from InfluenzaA__ADD23355__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucaacuacgaggagcuccgggagcagcugagcuccgugucguccuucgagauguucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgcuacagcaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagucgcgcgggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacucgaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagucgacccggaucuaccagauccuggcgaucuacuccaccgucgccagcucgcuggugcucguggucucccugggggccaucagcuucuggaugugcuccaacggcagccugcagugccgcaucugcaucuga

SEQ ID NO: 4472 - RNA, 1701 nt, Artificial Sequence; identical to SEQ ID NO: 4466
  derived and/or modified CDS sequence (AUadapt) from InfluenzaA__ADD23375__HA

SEQ ID NO: 4473 - RNA, 1701 nt, Artificial Sequence; identical to SEQ ID NO: 4078
  derived and/or modified CDS sequence (AUadapt) from InfluenzaA__ADD23385__HA

SEQ ID NO: 4474 - RNA, 1701 nt, Artificial Sequence
  derived and/or modified CDS sequence (AUadapt) from InfluenzaA__ADD23405__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccguggggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggucaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgucaagcucgagagcacccgcaucuaccagauccuggcgaucuacuccaccguggccucgagccuggugcucgucgugucccugggggccaucucguucuggaugugcuccaacggcagccugcagugccggaucugcaucuga

SEQ ID NO: 4475 - RNA, 1701 nt, Artificial Sequence
  derived and/or modified CDS sequence (AUadapt) from InfluenzaA__ADD23415__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgaguccgggaucaucaucagcgacacgcccgugcacgacugcaacacgaccugccagaccccgaagggcgccaucaacaccucccugcccuuccagaacauccaccccaucaccaucggcaagugccccaaguacgucaagucgaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagucgacccagaacgcgaucgacaagaucaccaacaaggugaacuccgucaucgagaagaugaacacccaguucacggccguggggaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcucgagagcacccgcaucuaccagauccuggcgaucuacuccaccgucgccucgagccuggugcucguggucucccugggcgccaucucguucuggaugugcuccaacgggagccugcagugccggaucugcaucuga

SEQ ID NO: 4476 - RNA, 1701 nt, Artificial Sequence; identical to SEQ ID NO: 4078
  derived and/or modified CDS sequence (AUadapt) from InfluenzaA__ADD23435__HA

SEQ ID NO: 4477 - RNA, 1701 nt, Artificial Sequence
  derived and/or modified CDS sequence (AUadapt) from InfluenzaA__ADD23465__HA
augaaggccauccuggccgugcuccuguacaccuucgcgaccgccaacgccgacacgcugugcaucggcuaccacgccaacaacucgaccgacaccgucgacaccgugcucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagucgcuguccaccgccagcuccuggucguacaucgucgagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggugaccgccgccugcccgcacgcgggcgccaaguccuucuacaagaaccugaucuggcucgucaagaaggggaacagcuaccccaagcuguccaagucguacaucaacgacaagggcaaggaggugcuggugcucugggggauccaccaccccagcaccuccgccgaccagcagucgcuguaccagaacgccgacgccuacgucuucgugggcacgucccgguacagcaagaaguucaagcccgagaucgcgauccgcccgaaggugcgggaccaggagggccgcaugaacuacuacuggacccuggucgagcccggggacaagaucaccuucgaggccaccggcaaccucguggugccccgguacgccuucgccauggagcgcaacgccggguccggcaucaucaucucggacacgcccguccacgacugcaacacgaccugccagaccccgaagggcgcgaucaacaccucccugcccuuccagaacauccaccccaucaccaucgggaagugccccaaguacgucaagagcaccaagcugcggcucgccaccggccugcgcaacgugccguccauccagucgcgggggcuguucggcgccaucgccggguucaucgagggcggcuggacggggaugguggacggcugguacggguaccaccaccagaacgagcagggcuccggguacgccgcggaccucaagucgacccagaacgccaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggcgaagcugaaccgggaggagaucgacggcgugaagcucgagagcacccgcaucuaccagauccuggccaucuacuccaccguggccucgagccugguccucguggugucccugggggccaucucguucuggaugugcuccaacggcagccugcagugccggaucugcaucuga

SEQ ID NO: 4478 - RNA, 1701 nt, Artificial Sequence; identical to SEQ ID NO: 4078
  derived and/or modified CDS sequence (AUadapt) from InfluenzaA__ADD23475__HA

SEQ ID NO: 4479 - RNA, 1701 nt, Artificial Sequence; identical to SEQ ID NO: 4078
  derived and/or modified CDS sequence (AUadapt) from InfluenzaA__ADD23485__HA

SEQ ID NO: 4480 - RNA, 1701 nt, Artificial Sequence
  derived and/or modified CDS sequence (AUadapt) from InfluenzaA__ADD23495__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgcgguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgcuacucgaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggcgaucuacuccaccgucgccucgagccuggugcucguggucucccugggggccaucucguucuggaugugcuccaacggcagccugcagugccgcaucugcaucuga

SEQ ID NO: 4481 - RNA, 1701 nt, Artificial Sequence
  derived and/or modified CDS sequence (AUadapt) from InfluenzaA__ADD23505__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugaucgagcccggggacaagaucaccuucgaggcgaccggcaaccucguggugccccgguacgccuucgccauggagcgcaacgccggguccggcaucaucaucucggacacgcccgcccacgacugcaacacgaccugccagaccccgaagggcgcgaucaacaccucccugcccuuccagaacauccaccccaucaccaucgggaagugccccaaguacgucaagagcaccaagcugcggcucgccaccggccugcgcaacgugccguccauccagucgcgggggcuguucggcgccaucgccggguucaucgagggcggcuggacggggaugguggacggcugguacggguaccaccaccagaacgagcagggcuccggguacgccgcggaccucaagucgacccagaacgccaucgacaagaucaccaacaaggucaacuccgugaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagucggugaagaacgggaccuacgacuaccccaaguacuccgaggaggcgaagcugaaccgggaggagaucgacggcgucaagcucgagagcacccgcaucuaccagauccuggccaucuacuccaccguggccucgagccuggugcucgucgugucccugggggccaucucguucuggaugugcuccaacggcagccugcagugccggaucugcaucuga

SEQ ID NO: 4482 - RNA, 1701 nt, Artificial Sequence; identical to SEQ ID NO: 4078
  derived and/or modified CDS sequence (AUadapt) from InfluenzaA__ADD23515__HA

SEQ ID NO: 4483 - RNA, 1701 nt, Artificial Sequence; identical to SEQ ID NO: 4078
  derived and/or modified CDS sequence (AUadapt) from InfluenzaA__ADD23994__HA

SEQ ID NO: 4484 - RNA, 1701 nt, Artificial Sequence
  derived and/or modified CDS sequence (AUadapt) from InfluenzaA__ADD24004__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaacggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaagaucgacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgagccugguccucguggugucccugggggccaucucguucuggaugugcuccaacggcagccugcagugccggaucugcaucuga

SEQ ID NO: 4485 - RNA, 1701 nt, Artificial Sequence; identical to SEQ ID NO: 4016
  derived and/or modified CDS sequence (AUadapt) from InfluenzaA__ADD24014__HA

SEQ ID NO: 4486 - RNA, 1701 nt, Artificial Sequence
  derived and/or modified CDS sequence (AUadapt) from InfluenzaA__ADD52537__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacggcaucaccaacaaggugaacucggucaucgagaagaugaacacccaguucaccgccgugggcaaggaguucaaccaccuggagaagcgcaucgagaaccugaacaagaaggucgacgacggguuccucgacaucuggacguacaacgccgagcugcuggugcuccuggagaacgagcggacccuggacuaccacgacuccaacgugaagaaccucuacgagaagguccgcagccagcugaagaacaacgccaaggagaucggcaacgggugcuucgaguucuaccacaagugcgacaacacgugcauggaguccgugaagaacggcaccuacgacuaccccaaguacucggaggaggccaagcugaaccgggaggagaucgacggggugaagcucgaguccacccgcaucuaccagauccuggcgaucuacagcaccgucgccucgucccuggugcucguggucagccugggcgccaucuccuucuggaugugcagcaacggcucccugcagugccggaucugcaucuga

SEQ ID NO: 4487 - RNA, 1701 nt, Artificial Sequence; identical to SEQ ID NO: 4078
  derived and/or modified CDS sequence (AUadapt) from InfluenzaA__ADD64203__HA

SEQ ID NO: 4488 - RNA, 1701 nt, Artificial Sequence
  derived and/or modified CDS sequence (AUadapt) from InfluenzaA__ADD64204__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacccgaacaagggggucaccgccgccugcccccacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacguguucgugggcacgucgcgguacuccaagaaguucaagccggagaucgccauccgccccaagguccgggaccaggagggccgcaugaacuacuacuggacccugaucgagcccggggagaagaucaccuucgaggcgaccggcaaccucguggugccccgguacgccuucgccauggagcgcaacgccgggagcggcaucaucaucuccgacacgccgguccacgacugcaacacgaccugccagacccccaagggcgccaucaacaccucgcugcccuuccagaacauccaccccaucaccaucgggaagugcccgaaguacgugaaguccaccaagcugcggcucgcgaccggccugcgcaacgugcccagcauccagucccgggggcuguucggcgccaucgccggguucaucgagggcggcuggacggggauggucgacggcugguacggguaccaccaccagaacgagcagggcucgggguacgccgccgaccucaaguccacccagaacgcgaucgacgagaucaccaacaaggugaacagcgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcucgcagcugaagaacaacgcccgggagaucgggaacggcugcuucgaguucuaccacaagugcgacaacacgugcauggaguccgucaagaacgggaccuacgacuaccccaaguacagcgaggaggccaagcugaaccgcgaggagaucgacggcgugaagcucgaguccacccggaucuaccagauccuggcgaucuacucgaccguggccuccagccugguccucguggugucgcugggggccaucuccuucuggaugugcagcaacggcucccugcagugccgcaucugcaucuga

SEQ ID NO: 4489 - RNA, 1701 nt, Artificial Sequence; identical to SEQ ID NO: 116
  derived and/or modified CDS sequence (AUadapt) from InfluenzaA__ADD64205__HA

SEQ ID NO: 4490 - RNA, 1701 nt, Artificial Sequence; identical to SEQ ID NO: 116
  derived and/or modified CDS sequence (AUadapt) from InfluenzaA__ADD64206__HA

SEQ ID NO: 4491 - RNA, 1701 nt, Artificial Sequence; identical to SEQ ID NO: 3712
  derived and/or modified CDS sequence (AUadapt) from InfluenzaA__ADD64207__HA

SEQ ID NO: 4492 - RNA, 1701 nt, Artificial Sequence
  derived and/or modified CDS sequence (AUadapt) from InfluenzaA__ADD64208__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccagcuccgacaacggcacgugcuaccccggcgacuucaucgacuacgaggagcuccgggagcagcugucguccgugucguccuucgagcgcuucgagaucuuccccaagaccagcuccuggcccaaccacgacccgaacaagggggucaccgccgccugcccccacgccggcgccaagucguucuacaagaaccugaucuggcucgugaagaaggggaacuccuaccccaagcugagcaaguccuacaucaacgacaagggcaaggaggugcugguccucugggggauccaccaccccucgaccagcgccgaccagcagucccuguaccagaacgccgacgccuacguguucgugggcacgucgcgguacuccaagaaguucaagccggagaucgccauccgccccaagguccgggaccaggagggccgcaugaacuacuacuggacccugguggagcccggggacaagaucaccuucgaggcgaccggcaaccucguggucccccgguacgccuucgccauggagcgcaacgccgggucgggcaucaucaucuccgacacgccggugcacgacugcaacacgaccugccagacccccaagggcgccaucaacaccagccugcccuuccagaacauccaccccaucaccaucgggaagugcccgaaguacgugaaguccaccaagcugcggcucgcgaccggccugcgcaacguccccucgauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacucggucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgaccccaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgucccuggugcucguggucagccugggggccaucucguucuggaugugcuccaacggcagccugcagugccggaucugcaucuga

SEQ ID NO: 4493 - RNA, 1701 nt, Artificial Sequence; identical to SEQ ID NO: 3712
  derived and/or modified CDS sequence (AUadapt) from InfluenzaA__ADD64209__HA

SEQ ID NO: 4494 - RNA, 1701 nt, Artificial Sequence; identical to SEQ ID NO: 116
  derived and/or modified CDS sequence (AUadapt) from InfluenzaA__ADD64210__HA

SEQ ID NO: 4495 - RNA, 1701 nt, Artificial Sequence; identical to SEQ ID NO: 3712
  derived and/or modified CDS sequence (AUadapt) from InfluenzaA__ADD64211__HA

SEQ ID NO: 4496 - RNA, 1701 nt, Artificial Sequence; identical to SEQ ID NO: 116
  derived and/or modified CDS sequence (AUadapt) from InfluenzaA__ADD64212__HA

SEQ ID NO: 4497 - RNA, 1701 nt, Artificial Sequence; identical to SEQ ID NO: 3712
  derived and/or modified CDS sequence (AUadapt) from InfluenzaA__ADD64213__HA

SEQ ID NO: 4498 - RNA, 1701 nt, Artificial Sequence
  derived and/or modified CDS sequence (AUadapt) from InfluenzaA__ADD64214__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggagaacaagcacaacgggaagcucugcaagcugcgcggcgucgcgccccugcaccucgggaagugcaacaucgccggcuggauccuggggaacccggagugcgagagcuucuccaccucguccagcugguccuacaucguggagaccucguccagcgacaacggcacgugcuaccccggcgacuucaucgacuacgaggagcugcgggagcagcucuccucgguguccagcuucgagcgcuucgagaucuuccccaagaccuccucguggcccaaccacgacuccaacaagggggucaccgccgccugcccgcacgccggcgccaagagcuucuacaagaaccugaucuggcuggugaagaaggggaacuccuaccccaagcucaacaagucguacaucaacgacaagggcaaggaggugcugguccugugggggauccaccaccccagcaccuccgcggaccagcagucgcucuaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggccaccggcaaccugguggucccccgguacgcguucgccauggagcgcaacgccggguccggcaucaucaucucggacacgcccgugcacgacugcaacacgaccugccagaccccgaagggcgccaucaacaccucccuccccuuccagaacauccaccccaucaccaucgggaagugccccaaguacgucaagagcaccaagcugcggcuggccaccggccuccgcaacgugccguccauccagucgcgggggcuguucggcgcgaucgccggguucaucgagggcggcuggacggggaugguggacggcugguacggguaccaccaccagaacgagcagggcuccggguacgccgccgaccucaagagcacccagaacgccaucgacggcaucaccaacaaggugaacuccgucaucgagaagaugaacacccaguucacggcggugggcaaggaguucaaccaccuggagaagcgcaucgagaaccugaacaagaaggucgacgacggguuccuggacaucuggaccuacaacgccgagcuccuggugcugcucgagaacgagcggacccuggacuaccacgacucgaacgugaagaaccuguacgagaagguccgcucccagcucaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcuggagucgacccgcaucuaccagauccucgccaucuacuccaccgucgcgagcucgcuggugcugguggucucccucggcgccaucagcuucuggaugugcuccaacggcagccugcagugccggaucugcaucuga

SEQ ID NO: 4499 - RNA, 1701 nt, Artificial Sequence; identical to SEQ ID NO: 116
  derived and/or modified CDS sequence (AUadapt) from InfluenzaA__ADD64215__HA

SEQ ID NO: 4500 - RNA, 1701 nt, Artificial Sequence; identical to SEQ ID NO: 3712
  derived and/or modified CDS sequence (AUadapt) from InfluenzaA__ADD64216__HA

SEQ ID NO: 4501 - RNA, 1701 nt, Artificial Sequence; identical to SEQ ID NO: 3712
  derived and/or modified CDS sequence (AUadapt) from InfluenzaA__ADD64217__HA

SEQ ID NO: 4502 - RNA, 1701 nt, Artificial Sequence
  derived and/or modified CDS sequence (AUadapt) from InfluenzaA__ADD74350__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgcgucguccuggagcuacaucguggagaccuccucguccgacaacggcacgugcuaccccggcgacuucaucgacuacgaggagcugcgggagcagcucagcuccgugucguccuucgagcgcuucgagaucuuccccaagaccagcuccuggcccaaccacgacucgaacaagggggucaccgccgccugcucccacgccggcgccaagagcuucuacaagaaccugaucuggcuggugaagaaggggaacuccuacccgaagcucucgaagagcuacaucaacgacaagggcaaggaggugcugguccugugggggauccaccaccccuccaccagcgccgaccagcagucccucuaccagaacgccgacgccuacguguucgugggcucgucccgguacagcaagaaguucaagcccgagaucgccauccgccccaagguccgggaccaggagggccgcaugaacuacuacuggacgcugguggagccgggggacaagaucaccuucgaggcgaccggcaaccugguggucccccgguacgccuucgccauggagcgcaacgccggguccggcaucaucaucucggacacccccgugcacgacugcaacacgaccugccagacccccaagggcgccaucaacaccucccucccguuccagaacauccaccccaucacgaucgggaagugccccaaguacgucaagagcaccaagcugcggcuggcgaccggccuccgcaacgugcccuccauccagucgcgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccuggacaucuggacguacaacgccgagcuccuggugcugcucgagaacgagcggacccuggacuaccacgacucgaacgugaagaaccuguacgagaagguccgcucccagcucaagaacaacgccaaggagaucgggaacggcugcuucgaguucuaccacaagugcgacaacacgugcauggagagcgugaagaacgggaccuacgacuacccgaaguacuccgaggaggccaagcugaaccgggaggagaucgacggcgugaagcuggagucgacccgcaucuaccagauccucgcgaucuacagcaccgucgccuccucgcuggugcugguggucucccucggggccaucagcuucuggaugugcuccaacggcagccugcagugccggaucugcaucuga

SEQ ID NO: 4503 - RNA, 1701 nt, Artificial Sequence
  derived and/or modified CDS sequence (AUadapt) from InfluenzaA__ADD74360__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagcggaaggaggugcugguccucuggggcauccaccaccccucgaccuccgccgaccagcagagccuguaccagaacgccgacgccuacguguucguggggacgucccgcuacucgaagaaguucaagcccgagaucgccauccggccgaagguccgcgaccaggagggccggaugaacuacuacuggacccugguggagcccggcgacaagaucaccuucgaggcgaccgggaaccucguggucccccgcuacgccuucgccauggagcggaacgccggcuccgggaucaucaucagcgacacgcccgugcacgacugcaacacgaccugccagaccccgaagggcgccaucaacaccucccugcccuuccagaacauccaccccaucaccaucggcaagugccccaaguacgucaagucgaccaagcugcgccucgcgaccgggcugcggaacgugccguccauccagagccgcggccuguucggggccaucgccggcuucaucgagggcggguggacgggcaugguggacgggugguacggcuaccaccaccagaacgagcagggguccggcuacgccgccgaccucaagucgacccagaacgcgaucgacgagaucaccaacaaggugaacuccgucaucgagaagaugaacacccaguucacggccguggggaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgcgaggagaucgacggggugaagcucgagagcacccggaucuaccagauccuggcgaucuacuccaccgucgccucgagccuggugcucguggucucccugggcgccaucucguucuggaugugcuccaacgggagccugcagugccgcaucugcaucuga

SEQ ID NO: 4504 - RNA, 1701 nt, Artificial Sequence; identical to SEQ ID NO: 116
  derived and/or modified CDS sequence (AUadapt) from InfluenzaA__ADD74370__HA

SEQ ID NO: 4505 - RNA, 1701 nt, Artificial Sequence; identical to SEQ ID NO: 116
  derived and/or modified CDS sequence (AUadapt) from InfluenzaA__ADD74398__HA

SEQ ID NO: 4506 - RNA, 1701 nt, Artificial Sequence
  derived and/or modified CDS sequence (AUadapt) from InfluenzaA__ADD74428__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccuggugaagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 4507 - RNA, 1701 nt, Artificial Sequence
  derived and/or modified CDS sequence (AUadapt) from InfluenzaA__ADD74438__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagcccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 4508 - RNA, 1701 nt, Artificial Sequence; identical to SEQ ID NO: 116
  derived and/or modified CDS sequence (AUadapt) from InfluenzaA__ADD74448__HA

SEQ ID NO: 4509 - RNA, 1701 nt, Artificial Sequence; identical to SEQ ID NO: 116
  derived and/or modified CDS sequence (AUadapt) from InfluenzaA__ADD74458__HA

SEQ ID NO: 4510 - RNA, 1701 nt, Artificial Sequence
  derived and/or modified CDS sequence (AUadapt) from InfluenzaA__ADD74468__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccguggaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucaccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggccaucuacuccaccgucgcgucgagccuggugcucguggucucccugggggccaucucguucuggaugugcuccaacggcagccugcagugccggaucugcaucuga

SEQ ID NO: 4511 - RNA, 1701 nt, Artificial Sequence
  derived and/or modified CDS sequence (AUadapt) from InfluenzaA__ADD74488__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccagcuccgacaacggcacgugcuaccccggcgacuucaucgacuacgaggagcugcgggagcagcucucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcuggugaagaaggggaacucguaccccaagcucuccaagagcuacaucaacgacaagggcaaggaggugcugguccugugggggauccaccaccccucgaccuccgccgaccagcagagccucuaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucgccauggagcgcaacgccggguccggcaucaucaucagcgacacgcccgugcacgacugcaacacgaccugccagaccccgaagggcgccaucaacaccucccuccccuuccagaacauccaccccaucaccaucgggaagugccccaaguacgucaagucgaccaagcugcggcuggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcuggagagcacccgcaucuaccagauccucgcgaucuacuccaccgucgccucgagccuggugcugguggucucccucggggccaucucguucuggaugugcuccaacggcagccugcagugccggaucugcaucuga

SEQ ID NO: 4512 - RNA, 1701 nt, Artificial Sequence; identical to SEQ ID NO: 116
  derived and/or modified CDS sequence (AUadapt) from InfluenzaA__ADD74498__HA

SEQ ID NO: 4513 - RNA, 1701 nt, Artificial Sequence
  derived and/or modified CDS sequence (AUadapt) from InfluenzaA__ADD74508__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccguggaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccgaggcgaaguccuucuacaagaaccugaucuggcucgugaagaagggcaacucguaccccaagcuguccaagagcuacaucaacgacaaggggaaggaggugcugguccucuggggcauccaccaccccucgaccuccgccgaccagcagagccuguaccagaacgccgacgccuacguguucguggggacgucccgguacucgaagaaguucaagcccgagaucgccauccgcccgaagguccgggaccaggagggccgcaugaacuacuacuggacccugguggagcccggcgacaagaucaccuucgaggcgaccgggaaccucguggucccccgguacgccuucgccauggagcgcaacgccggcuccgggaucaucaucagcgacacgcccgugcacgacugcaacacgaccugccagaccccgaagggcgccaucaacaccucccugcccuuccagaacauccaccccaucaccaucggcaagugccccaaguacgucaagucgaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagucgacccagaacgcgaucgacgagaucaccaacaaggugaacuccgucaucgagaagaugaacacccaguucacggccguggggaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcucgagagcacccgcaucuaccagauccuggcgaucuacuccaccgucgccucgagccuggugcucguggucucccugggcgccaucucguucuggaugugcuccaacgggagccugcagugccggaucugcaucuga

SEQ ID NO: 4514 - RNA, 1701 nt, Artificial Sequence
  derived and/or modified CDS sequence (AUadapt) from InfluenzaA__ADD74518__HA
augaaggccauccuggugguccuccuguacaccuucgccaccgcgaacgccgacacgcugugcaucggcuaccacgccaacaacucgaccgacaccguggacaccauccucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagucgcuguccaccgccagcuccuggucguacaucgucgagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggugaccgccgccugcccgcacgccggcgcgaaguccuucuacaagaaccugaucuggcucgucaagaaggggaacucguaccccaagcuguccaagagcuacaucaacgacaagggcaaggagauccuggugcucugggggauccaccaccccucgaccuccgccgaccagcagagccuguaccagaacgccgacgccuacguguucgucggcacgucccgguacucgaagaaguucaagcccgagaucgccauccgcccgaaggugcgggaccaggagggccgcaugaacuacuacuggacccugguggagcccggggacaagaucaccuucgaggcgaccggcaaccucgucgugccccgguacgccuucgccauggagcgcaacacgggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacgagaucaccaacaaggucaacuccgugaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgucaagcucgagagcacccgcaucuaccagauccuggccaucuacuccaccguggcgucgagccuggugcucgucgugucccugggggccaucucguucuggaugugcuccaacggcagccugcagugccggaucugcaucuga

SEQ ID NO: 4515 - RNA, 1701 nt, Artificial Sequence
  derived and/or modified CDS sequence (AUadapt) from InfluenzaA__ADD74528__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguuccagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 4516 - RNA, 1701 nt, Artificial Sequence
  derived and/or modified CDS sequence (AUadapt) from InfluenzaA__ADD74538__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugccgccugcggggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgcgagcagcugagcuccgugucguccuucgagcgguucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgcuacagcaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucucggacacgcccguguacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagucgcgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacucgaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagucgacccggaucuaccagauccuggcgaucuacuccaccgucgccagcucgcuggugcucguggucucccugggggccaucagcuucuggaugugcuccaacggcagccugcagugccgcaucugcaucuga

SEQ ID NO: 4517 - RNA, 1701 nt, Artificial Sequence; identical to SEQ ID NO: 4511
  derived and/or modified CDS sequence (AUadapt) from InfluenzaA__ADD74548__HA

SEQ ID NO: 4518 - RNA, 1701 nt, Artificial Sequence; identical to SEQ ID NO: 4078
  derived and/or modified CDS sequence (AUadapt) from InfluenzaA__ADD74558__HA

SEQ ID NO: 4519 - RNA, 1701 nt, Artificial Sequence; identical to SEQ ID NO: 4466
  derived and/or modified CDS sequence (AUadapt) from InfluenzaA__ADD74568__HA

SEQ ID NO: 4520 - RNA, 1701 nt, Artificial Sequence
  derived and/or modified CDS sequence (AUadapt) from InfluenzaA__ADD74578__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccucguccagcugguccuacaucguggagaccucguccagcgacaacggcacgugcuaccccggcgacuucaucgacuacgaggagcuccgggagcagcuguccucgguguccagcuucgagcgcuucgagaucuuccccaagaccuccucguggcccaaccacgacuccaacaagggggucaccgccgccugcccgcacgccggcgccaagagcuucuacaagaaccugaucuggcucgugaagaaggggaacuccuaccccaagcugucgaagagcuacaucaacgacaagggcaaggaggugcugguccucugggggauccaccaccccuccaccucgacggaccagcagucccuguaccagaacgcggacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggccacgggcaaccucguggucccccgguacgccuucgcgauggagcgcaacgccgggucgggcaucaucaucuccgacacccccgugcacgacugcaacacgaccugccagaccccgaagggcgccaucaacaccagccugcccuuccagaacauccaccccaucaccaucgggaagugccccaaguacgugaaguccaccaagcugcggcucgccacgggccugcgcaacgucccgucgauccagucccgggggcuguucggcgccaucgcgggguucaucgagggcggcuggaccgggaugguggacggcugguacggguaccaccaccagaacgagcagggcagcggguacgccgccgaccucaaguccacccagaacgccaucgacgagaucaccaacaaggugaacucggucaucgagaagaugaacacgcaguucaccgccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggccaucuacagcaccgucgccucgucccuggugcucguggucagccugggggcgaucuccuucuggaugugcagcaacggcucccugcagugccggaucugcaucuga

SEQ ID NO: 4521 - RNA, 1701 nt, Artificial Sequence
  derived and/or modified CDS sequence (AUadapt) from InfluenzaA__ADD74588__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgacggccagcagagccuguaccagaacgccgacgccuacguguucgugggcacgucccgguacucgaagaaguucaagcccgagaucgccauccgcccgaagguccgggaccaggaggggcgcaugaacuacuacuggacccugguggagcccggcgacaagaucaccuucgaggccaccgggaaccucguggucccccgguacgcguucgccauggagcgcaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagucgaccaagcugcggcucgccaccgggcugcgcaacgugccguccauccagagccggggccuguucggggcgaucgccggcuucaucgagggcggguggacgggcaugguggacgggugguacggcuaccaccaccagaacgagcagggguccggcuacgccgccgaccucaagucgacccagaacgccaucgacgagaucaccaacaaggugaacuccgucaucgagaagaugaacacccaguucacggcggugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagucggugaagaacggcaccuacgacuaccccaaguacuccaaggaggccaagcugaaccgggaggagaucgacggggugaagcucgagagcacccgcaucuaccagauccuggccaucuacuccaccgucgcgucgagccuggugcucguggucucccugggcgccaucucguucuggaugugcuccaacggcagccugcagugccggaucugcaucuga

SEQ ID NO: 4522 - RNA, 1701 nt, Artificial Sequence; identical to SEQ ID NO: 4466
  derived and/or modified CDS sequence (AUadapt) from InfluenzaA__ADD74598__HA

SEQ ID NO: 4523 - RNA, 1701 nt, Artificial Sequence; identical to SEQ ID NO: 4466
  derived and/or modified CDS sequence (AUadapt) from InfluenzaA__ADD74608__HA

SEQ ID NO: 4524 - RNA, 1701 nt, Artificial Sequence; identical to SEQ ID NO: 4078
  derived and/or modified CDS sequence (AUadapt) from InfluenzaA__ADD74618__HA

SEQ ID NO: 4525 - RNA, 1701 nt, Artificial Sequence
  derived and/or modified CDS sequence (AUadapt) from InfluenzaA__ADD74628__HA
augaaggccauccuggugguccuccuguacaccuucgccaccgcgaacgccgacacgcugugcaucggcuaccacgccaacaacucgaccgacaccguggacaccauccucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagucgcuguccaccgccagcuccuggucguacaucgucgagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggugaccgccgccugcccgcacgccggcgcgaaguccuucuacaagaaccugaucuggcucgucaagaaggggaacucguaccccaagcuguccaagagcuacaucaacgacaagggcaaggagauccuggugcucugggggauccaccaccccucgaccuccgccgaccagcagagccuguaccagaacgccgacgccuacguguucgucggcacgucccgguacucgaagaaguucaagcccgagaucgccauccgcccgaaggugcgggaccaggagggccgcaugaacuacuacuggacccugguggagcccggggacaagaucaccuucgaggcgaccggcaaccucgucgugccccgguacgccuucgccauggagaagaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggucaacuccgugaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgucaagaaccucuacgagaaggugcggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgucaagcucgagagcacccggaucuaccagauccuggcgaucuacuccaccguggccucgagccuggugcucgucgugucccugggggccaucucguucuggaugugcuccaacggcagccugcagugccgcaucugcaucuga

SEQ ID NO: 4526 - RNA, 1701 nt, Artificial Sequence; identical to SEQ ID NO: 4015
  derived and/or modified CDS sequence (AUadapt) from InfluenzaA__ADD74648__HA

SEQ ID NO: 4527 - RNA, 1701 nt, Artificial Sequence
  derived and/or modified CDS sequence (AUadapt) from InfluenzaA__ADD74658__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacuccuacguguucgugggcacgagccgguacuccaagaaguucaagcccgagaucgccauccgcccgaagguccgggaccaggagggccgcaugaacuacuacuggacccugguggagcccggggacaagaucaccuucgaggccaccggcaaccucguggucccccgguacgcguucgccauggagcgcaacgccgggucgggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgucgauccagucccgggggcuguucggcgcgaucgccggguucaucgagggcggcuggacggggaugguggacggcugguacggguaccaccaccagaacgagcagggcagcggguacgccgccgaccucaaguccacccagaacgccaucgacgagaucaccaacaaggugaacucggucaucgagaagaugaacacccaguucacggcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggccaucuacagcaccgucgcgucgucccuggugcucguggucagccugggggccaucuccuucuggaugugcagcaacggcucccugcagugccggaucugcaucuga

SEQ ID NO: 4528 - RNA, 1701 nt, Artificial Sequence; identical to SEQ ID NO: 4466
  derived and/or modified CDS sequence (AUadapt) from InfluenzaA__ADD74668__HA

SEQ ID NO: 4529 - RNA, 1701 nt, Artificial Sequence; identical to SEQ ID NO: 4506
  derived and/or modified CDS sequence (AUadapt) from InfluenzaA__ADD74678__HA

SEQ ID NO: 4530 - RNA, 1701 nt, Artificial Sequence; identical to SEQ ID NO: 4466
  derived and/or modified CDS sequence (AUadapt) from InfluenzaA__ADD74688__HA

SEQ ID NO: 4531 - RNA, 1701 nt, Artificial Sequence
  derived and/or modified CDS sequence (AUadapt) from InfluenzaA__ADD74698__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 4532 - RNA, 1701 nt, Artificial Sequence; identical to SEQ ID NO: 4466
  derived and/or modified CDS sequence (AUadapt) from InfluenzaA__ADD74708__HA

SEQ ID NO: 4533 - RNA, 1701 nt, Artificial Sequence
  derived and/or modified CDS sequence (AUadapt) from InfluenzaA__ADD74728__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccgaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagcguggugcuggucgugucccucggggccaucucguucuggaugugcuccaacggcagccugcagugccggaucugcaucuga

SEQ ID NO: 4534 - RNA, 1701 nt, Artificial Sequence
  derived and/or modified CDS sequence (AUadapt) from InfluenzaA__ADD74738__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgcggagcugguccuacaucguggagaccucguccagcgacaacggcacgugcuaccccggcgacuucaucgacuacgaggagcuccgcgagcagcuguccucgguguccagcuucgagcgguucgagaucuuccccaagaccuccucguggcccaaccacgacuccaacaagggggucaccgccgccugcccgcacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacguguucgugggcacgucgggcuacuccaagaaguucaagcccgagaucgccauccgcccgaagguccgggaccaggaggggcgcaugaacuacuacuggacccugguggagcccggcgacaagaucaccuucgaggcgaccgggaaccucguggucccccgguacgccuucgccauggagcgcaacgccggcagcggcaucaucaucuccgacacgcccgugcacgacugcaacacgaccugccagaccccgaagggggccaucaacaccucgcugcccuuccagaacauccaccccaucaccaucggcaagugccccaaguacgugaaguccaccaagcugcggcucgcgaccgggcugcgcaacgucccgagcauccagucccggggccuguucggggccaucgccggcuucaucgagggcggguggacgggcaugguggacgggugguacggcuaccaccaccagaacgagcaggggucgggcuacgccgccgaccucaaguccacccagaacgcgaucgacaagaucaccaacaaggugaacagcgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcaucuaccagauccuggcgaucuacucgaccgucgccuccagccuggugcucguggucucgcugggcgccaucuccuucuggaugugcagcaacggcucccugcagugccggaucugcaucuga

SEQ ID NO: 4535 - RNA, 1701 nt, Artificial Sequence; identical to SEQ ID NO: 4078
  derived and/or modified CDS sequence (AUadapt) from InfluenzaA__ADD74748__HA

SEQ ID NO: 4536 - RNA, 1701 nt, Artificial Sequence; identical to SEQ ID NO: 4078
  derived and/or modified CDS sequence (AUadapt) from InfluenzaA__ADD74758__HA

SEQ ID NO: 4537 - RNA, 1701 nt, Artificial Sequence
  derived and/or modified CDS sequence (AUadapt) from InfluenzaA__ADD74768__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcauguccuacuacuggacccugguggagcccggggacaagaucaccuucgaggcgaccggcaaccucguggucccccgguacgccuucgccauggagcgcaacgccgggucgggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgcgaccggccugcgcaacgucccgucgauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacaagaucaccaacaaggugaacucggucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 4538 - RNA, 1701 nt, Artificial Sequence; identical to SEQ ID NO: 4078
  derived and/or modified CDS sequence (AUadapt) from InfluenzaA__ADD74778__HA

SEQ ID NO: 4539 - RNA, 1701 nt, Artificial Sequence; identical to SEQ ID NO: 4466
  derived and/or modified CDS sequence (AUadapt) from InfluenzaA__ADD74788__HA

SEQ ID NO: 4540 - RNA, 1701 nt, Artificial Sequence; identical to SEQ ID NO: 4466
  derived and/or modified CDS sequence (AUadapt) from InfluenzaA__ADD74798__HA

SEQ ID NO: 4541 - RNA, 1701 nt, Artificial Sequence
  derived and/or modified CDS sequence (AUadapt) from InfluenzaA__ADD74808__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccagcuccgacaacggcacgugcuaccccggcgacuucaucgacuacgaggagcugcgggagcagcucucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcuggugaagaaggggaacucguaccccaagcucuccaagagcuacaucaacgacaagggcaaggaggugcugguccugugggggauccaccaccccucgaccuccgccgaccagcagagccucuaccagaacgccgacgccuacguguucgugggcuccucgcgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggagcggcaucaucaucuccgacacccccgugcacgacugcaacacgaccugccagaccccgaagggcgccaucaacaccucgcuccccuuccagaacauccaccccaucacgaucgggaagugccccaaguacgugaaguccaccaagcugcggcuggcgaccggccuccgcaacgucccgagcauccagucccgggggcuguucggcgccaucgccggguucaucgagggcggcuggaccgggaugguggacggcugguacggguaccaccaccagaacgagcagggcucgggguacgccgccgaccugaaguccacgcagaacgcgaucgacgagaucaccaacaaggugaacagcgucaucgagaagaugaacacccaguucaccgccgugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcucgcagcucaagaacaacgccaaggagguggggaacggcugcuucgaguucuaccacaagugcgacaacacgugcauggaguccgugaagaacgggaccuacgacuaccccaaguacagcgaggaggccaagcugaaccgggaggagaucgacggcgucaagcuggaguccacccgcaucuaccagauccucgcgaucuacucgaccgccgccagcucccuggugcugguggucucgcucggggccaucuccuucuggaugugcagcaacggcucccugcagugccggaucugcaucuga

SEQ ID NO: 4542 - RNA, 1701 nt, Artificial Sequence
  derived and/or modified CDS sequence (AUadapt) from InfluenzaA__ADD74818__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccagcuccgacaacggcacgugcuaccccggcgacuucaucgacuacgaggagcugcgggagcagcucucguccgugagcuccuucgagcgcuucgagaucuuccccaagaccucguccuggcccaaccacgacucgaacaagggggucaccgccgccugcccgcacgccggcgcgaaguccuucuacaagaaccugaucuggcuggugaagaaggggaacagcuaccccaagcucuccaagucguacaucaacgacaagggcaaggaggugcugguccugugggggauccaccaccccagcaccuccgccgaccagcagucgcucuaccagaacgccgacgccuacguguucgugggcacgucccgguacagcaagaaguucaagcccgagaucgccauccgcccgaagguccgggaccaggagggccgcaugaacuaccacuggacccugguggagcccggggacaagaucaccuucgaggcgaccggcaaccugguggucccccgguacgccuucgccauggagcgcaacgccggguccggcaucaucaucucggacacgcccgugcacgacugcaacacgaccugccagaccccgaagggcgccaucaacaccucccuccccuuccagaacauccaccccaucaccaucgggaagugccccaaguacgucaagagcaccaagcugcggcuggcgaccggccuccgcaacgugccguccauccagucgcgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcuggagagcacccgcaucuaccagauccucgcgaucuacuccaccgucgccucgagccuggugcugguggucucccucggggccaucucguucuggaugugcuccaacggcagccugcagugccggaucugcaucuga

SEQ ID NO: 4543 - RNA, 1701 nt, Artificial Sequence
  derived and/or modified CDS sequence (AUadapt) from InfluenzaA__ADD74838__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacgugcaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggucaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgucaagcucgagagcacccgcaucuaccagauccuggcgaucuacuccaccguggccucgagccuggugcucgucgugucccugggggccaucucguucuggaugugcuccaacggcagccugcagugccggaucugcaucuga

SEQ ID NO: 4544 - RNA, 1701 nt, Artificial Sequence
  derived and/or modified CDS sequence (AUadapt) from InfluenzaA__ADD74848__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucaucgugucccugggggccaucucguucuggaugugcuccaacggcagccugcagugccggaucugcaucuga

SEQ ID NO: 4545 - RNA, 1701 nt, Artificial Sequence
  derived and/or modified CDS sequence (AUadapt) from InfluenzaA__ADD74858__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacagcaacaagggggucaccgccgccugcccgcacgccggcaccaaguccuucuacaagaaccugaucuggcucgugaagaaggggaacucguaccccaagcuguccaagagcuacaucaacgacaagggcaaggaggugcugguccucugggggauccaccaccccucgacguccgcggaccagcagagccuguaccagaacgccgacgccuacguguucgugggcaccucccgguacucgaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacaagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggccaucuacuccaccgucgcgucgagccuggugcucguggucucccugggggccaucucguucuggaugugcuccaacggcagccugcagugccggaucugcaucuga

SEQ ID NO: 4546 - RNA, 1701 nt, Artificial Sequence; identical to SEQ ID NO: 4466
  derived and/or modified CDS sequence (AUadapt) from InfluenzaA__ADD74868__HA

SEQ ID NO: 4547 - RNA, 1701 nt, Artificial Sequence; identical to SEQ ID NO: 4466
  derived and/or modified CDS sequence (AUadapt) from InfluenzaA__ADD74878__HA

SEQ ID NO: 4548 - RNA, 1701 nt, Artificial Sequence
  derived and/or modified CDS sequence (AUadapt) from InfluenzaA__ADD74888__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccguggaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccaacucguggcccaaccacgacuccaacaagggggucaccgccgccugcccgcacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacguguucgugggcacgucgcgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccucgcugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcucgggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 4549 - RNA, 1701 nt, Artificial Sequence
  derived and/or modified CDS sequence (AUadapt) from InfluenzaA__ADD74898__HA
augaaggccauccuggugguccuccuguacaccuucaccacggccaacgcggacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagacguccagcuccgacaacgggaccugcuaccccggcgacuucaucaacuacgaggagcuccgggagcagcugucguccgugagcuccuucgagcgcuucgagaucuuccccaagaccucguccuggcccaaccacgacagcaacaagggcgucaccgccgccugcccgcacgccggcgccaaguccuucuacaagaaccugaucuggcucgugaagaaggggaacucguaccccaagcuguccaagagcuacaucaacgacaagggcaaggaggugcugguccucugggggauccaccaccccucgacguccgcggaccagcagagccuguaccagaacgccgacgccuacguguucgugggcaccucccgguacucgaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacaagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggccaucuacuccaccgucgcgucgagccuggugcucguggucucccugggggccaucucguucuggaugugcuccaacggcagccugcagugccggaucugcaucuga

SEQ ID NO: 4550 - RNA, 1701 nt, Artificial Sequence
  derived and/or modified CDS sequence (AUadapt) from InfluenzaA__ADD74908__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucacgauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggccaucuacuccaccgucgcgucgagccuggugcucguggucucccugggggccaucucguucuggaugugcuccaacggcagccugcagugccggaucugcaucuga

SEQ ID NO: 4551 - RNA, 1701 nt, Artificial Sequence; identical to SEQ ID NO: 4544
  derived and/or modified CDS sequence (AUadapt) from InfluenzaA__ADD74918__HA

SEQ ID NO: 4552 - RNA, 1701 nt, Artificial Sequence; identical to SEQ ID NO: 4466
  derived and/or modified CDS sequence (AUadapt) from InfluenzaA__ADD74928__HA

SEQ ID NO: 4553 - RNA, 1701 nt, Artificial Sequence; identical to SEQ ID NO: 4544
  derived and/or modified CDS sequence (AUadapt) from InfluenzaA__ADD74938__HA

SEQ ID NO: 4554 - RNA, 1701 nt, Artificial Sequence
  derived and/or modified CDS sequence (AUadapt) from InfluenzaA__ADD74958__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggagaacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 4555 - RNA, 1701 nt, Artificial Sequence; identical to SEQ ID NO: 4078
  derived and/or modified CDS sequence (AUadapt) from InfluenzaA__ADD74968__HA

SEQ ID NO: 4556 - RNA, 1701 nt, Artificial Sequence
  derived and/or modified CDS sequence (AUadapt) from InfluenzaA__ADD74998__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcgcggcuccggguacgccgccgaccucaagucgacccagaacgcgaucgacaagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggcgaucuacuccaccgucgccucgagccuggugcucguggucucccugggggccaucucguucuggaugugcuccaacggcagccugcagugccgcaucugcaucuga

SEQ ID NO: 4557 - RNA, 1701 nt, Artificial Sequence; identical to SEQ ID NO: 4078
  derived and/or modified CDS sequence (AUadapt) from InfluenzaA__ADD75008__HA

SEQ ID NO: 4558 - RNA, 1701 nt, Artificial Sequence; identical to SEQ ID NO: 4078
  derived and/or modified CDS sequence (AUadapt) from InfluenzaA__ADD75018__HA

SEQ ID NO: 4559 - RNA, 1701 nt, Artificial Sequence; identical to SEQ ID NO: 4078
  derived and/or modified CDS sequence (AUadapt) from InfluenzaA__ADD75028__HA

SEQ ID NO: 4560 - RNA, 1701 nt, Artificial Sequence; identical to SEQ ID NO: 4015
  derived and/or modified CDS sequence (AUadapt) from InfluenzaA__ADD75058__HA

SEQ ID NO: 4561 - RNA, 1701 nt, Artificial Sequence; identical to SEQ ID NO: 4334
  derived and/or modified CDS sequence (AUadapt) from InfluenzaA__ADD75088__HA

SEQ ID NO: 4562 - RNA, 1701 nt, Artificial Sequence; identical to SEQ ID NO: 116
  derived and/or modified CDS sequence (AUadapt) from InfluenzaA__ADD75098__HA

SEQ ID NO: 4563 - RNA, 1701 nt, Artificial Sequence
  derived and/or modified CDS sequence (AUadapt) from InfluenzaA__ADD75108__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacaucccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgagccugguccucguggugucccugggggccaucucguucuggaugugcuccaacggcagccugcagugccggaucugcaucuga

SEQ ID NO: 4564 - RNA, 1701 nt, Artificial Sequence; identical to SEQ ID NO: 116
  derived and/or modified CDS sequence (AUadapt) from InfluenzaA__ADD75118__HA

SEQ ID NO: 4565 - RNA, 1701 nt, Artificial Sequence; identical to SEQ ID NO: 3361
  derived and/or modified CDS sequence (AUadapt) from InfluenzaA__ADD75128__HA

SEQ ID NO: 4566 - RNA, 1701 nt, Artificial Sequence; identical to SEQ ID NO: 116
  derived and/or modified CDS sequence (AUadapt) from InfluenzaA__ADD75138__HA

SEQ ID NO: 4567 - RNA, 1701 nt, Artificial Sequence; identical to SEQ ID NO: 4078
  derived and/or modified CDS sequence (AUadapt) from InfluenzaA__ADD75148__HA

SEQ ID NO: 4568 - RNA, 1701 nt, Artificial Sequence; identical to SEQ ID NO: 116
  derived and/or modified CDS sequence (AUadapt) from InfluenzaA__ADD75158__HA

SEQ ID NO: 4569 - RNA, 1701 nt, Artificial Sequence
  derived and/or modified CDS sequence (AUadapt) from InfluenzaA__ADD84494__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaucagcuccuggcccaaccacgacccgaacaagggggucaccgccgccugcccccacgccggcgccaagucguucuacaagaaccugaucuggcucgugaagaaggggaacuccuaccccaagcugagcaaguccuacaucaacgacaagggcaaggaggugcugguccucugggggauccaccaccccucgaccagcgccgaccagcagucccuguaccagaacgccgacgccuacguguucgugggcaccucgcgguacuccaagaaguucaagccggagaucgccauccgccccaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacaccccggugcacggcugcaacacgaccugccagacccccaagggggccaucaacaccucgcugcccuuccagaacauccaccccaucacgaucggcaagugcccgaaguacgugaaguccaccaagcugcggcucgcgaccgggcugcgcaacguccccagcauccagucccggggccuguucggggccaucgccggcuucaucgagggcggguggaccggcaugguggacgggugguacggcuaccaccaccagaacgagcaggggucgggcuacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggguuccucgacaucuggacguacaacgccgagcugcuggugcuccuggagaacgagcggacccuggacuaccacgacuccaacgugaagaaccucuacgagaagguccgcucgcagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcaucuaccagauccuggcgaucuacucgaccgucgccuccagccuggugcucguggucucgcugggcgccaucuccuucuggaugugcagcaacggcucccugcagugccggaucugcaucuga

SEQ ID NO: 4570 - RNA, 1701 nt, Artificial Sequence
  derived and/or modified CDS sequence (AUadapt) from InfluenzaA__ADD84495__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaucagcuccuggcccaaccacgacccgaacaagggggucaccgccgccugcccccacgccggcgccaagucguucuacaagaaccugaucuggcucgugaagaaggggaacuccuaccccaagcugagcaaguccuacaucaacgacaagggcaaggaggugcugguccucugggggauccaccaccccucgaccagcgccgaccagcagucccuguaccagaacgccgacgccuacguguucgugggcaccucgcgguacuccaagaaguucaagccggagaucgccauccgccccaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacaccccggugcacgacugcaacacgaccugccagacccccaagggcgccaucaacaccucgcugcccuuccagaacauccaccccaucacgaucgggaagugcccgaaguacgugaaguccaccaagcugcggcucgcgaccggccugcgcaacguccccagcauccagucccgggggcuguucggcgccaucgccggguucaucgagggcggcuggaccgggaugguggacggcugguacggguaccaccaccagaacgagcagggcucgggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 4571 - RNA, 1701 nt, Artificial Sequence
  derived and/or modified CDS sequence (AUadapt) from InfluenzaA__ADD84496__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaucagcuccuggcccaaccacgacccgaacaagggggucaccgccgccugcccccacgccggcgccaagucguucuacaagaaccugaucuggcucgugaagaaggggaacuccuaccccaagcugagcaaguccuacaucaacgacaagggcaaggaggugcugguccucugggggauccaccaccccucgaccagcgccgaccagcagucccuguaccagaacgccgacgccuacguguucgugggcucgucccgguacagcaagaaguucaagccggagaucgccauccgccccaagguccgggaccaggagggccgcaugaacuacuacuggacccugguggagcccggggacaagaucacguucgaggcgaccggcaaccucguggucccccgguacgccuucgccauggagcgcaacgccggguccggcaucaucaucucggacaccccggugcacgacugcaacaccacgugccagacccccaagggcgccaucaacaccucccugcccuuccagaacauccaccccaucaccaucgggaagugcccgaaguacgucaagagcacgaagcugcggcucgcgaccggccugcgcaacgugcccuccauccagucgcgggggcuguucggcgccaucgccggguucaucgagggcggcuggaccgggaugguggacggcugguacggguaccaccaccagaacgagcagggcuccggguacgccgccgaccucaagagcacccagaacgcgaucgacgagaucacgaacaaggugaacuccgucaucgagaagaugaacacccaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacucgaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgacccgcaucuaccagauccuggcgaucuacuccaccgucgccagcucgcuggugcucguggucucccugggggccaucagcuucuggaugugcuccaacggcagccugcagugccggaucugcaucuga

SEQ ID NO: 4572 - RNA, 1701 nt, Artificial Sequence; identical to SEQ ID NO: 4570
  derived and/or modified CDS sequence (AUadapt) from InfluenzaA__ADD84497__HA

SEQ ID NO: 4573 - RNA, 1701 nt, Artificial Sequence
  derived and/or modified CDS sequence (AUadapt) from InfluenzaA__ADD84498__HA
augaaggccauccuggugguccuccuguacaccuucgccaccgcgaacgccgacacgcugugcaucggcuaccacgccaacaacucgaccgacaccguggugaccguccucgagaagaacgugacggugacccacuccgucaaccugcuggaggacaagcacaacgggaagcucugcaagcugcgcggcguggcgccccugcaccucgggaagugcaacaucgccggcuggauccuggggaacccggagugcgagagccuguccaccgcgucguccuggagcuacaucguggagaccuccucguccgacaacggcacgugcuaccccggcgacuucaucgacuacgaggagcuccgggagcagcugagcuccgucucguccuucgagcgcuucgagaucuuccccaagaucagcuccuggcccaaccacgacccgaacaagggggugaccgccgccugcccccacgccggcgccaagagcuucuacaagaaccugaucuggcucgugaagaaggggaacuccuaccccaagcugucgaaguccuacaucaacgacaagggcaaggagguccuggugcucugggggauccaccaccccagcaccucggccgaccagcagucccuguaccagaacgccgacgccuacguguucgucggcagcucccgguacucgaagaaguucaagccggagaucgccauccgccccaaggugcgggaccaggagggccgcaugaacuacuacuggacccugguggagcccggggacaagaucacguucgaggcgaccggcaaccucgucgugccccgguacgccuucgccauggagcgcaacgccggguccggcaucaucaucagcgacaccccggugcacgacugcaacaccacgugccagacccccaagggcgccaucaacaccucccugcccuuccagaacauccaccccaucaccaucgggaagugcccgaaguacgucaagucgacgaagcugcggcucgcgaccggccugcgcaacgugcccuccauccagagccgggggcuguucggcgccaucgccggguucaucgagggcggcuggaccgggaugguggacggcugguacggguaccaccaccagaacgagcagggcuccggguacgccgccgaccucaagagcacccagaacgcgaucgacgagaucacgaacaaggucaacuccgugaucgagaagaugaacacccaguucaccgccgucggcaaggaguucaaccaccuggagaagcgcaucgagaaccugaacaagaagguggacgacggcuuccucgacaucuggaccuacaacgccgagcugcuggugcuccuggagaacgagcggacgcuggacuaccacgacucgaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagucgacccgcaucuaccagauccuggcgaucuacuccaccguggccagcucgcuggugcucgucgugucccugggggccaucagcuucuggaugugcuccaacggcagccugcagugccggaucugcaucuga

SEQ ID NO: 4574 - RNA, 1701 nt, Artificial Sequence; identical to SEQ ID NO: 4570
  derived and/or modified CDS sequence (AUadapt) from InfluenzaA__ADD84499__HA

SEQ ID NO: 4575 - RNA, 1701 nt, Artificial Sequence
  derived and/or modified CDS sequence (AUadapt) from InfluenzaA__ADD92535__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccgcgagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaaccgggugaacuccgucaucgagaagaugaacacccaguucacggccgugggcaaggaguucaaccaccuggagaagcgcaucgagaaccugaacaagaaggucgacggcggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcucgagagcacccgcaucuaccagauccuggcgaucuacuccaccgucgccucgagccuggugcucguggucucccugggcgccaucucguucuggaugugcuccaacggcagccugcagugccggaucugcaucuga

SEQ ID NO: 4576 - RNA, 1701 nt, Artificial Sequence; identical to SEQ ID NO: 4502
  derived and/or modified CDS sequence (AUadapt) from InfluenzaA__ADD96766__HA

SEQ ID NO: 4577 - RNA, 1701 nt, Artificial Sequence; identical to SEQ ID NO: 96
  derived and/or modified CDS sequence (AUadapt) from InfluenzaA__ADD96776__HA

SEQ ID NO: 4578 - RNA, 1701 nt, Artificial Sequence; identical to SEQ ID NO: 96
  derived and/or modified CDS sequence (AUadapt) from InfluenzaA__ADD96786__HA

SEQ ID NO: 4579 - RNA, 1701 nt, Artificial Sequence; identical to SEQ ID NO: 4399
  derived and/or modified CDS sequence (AUadapt) from InfluenzaA__ADD96796__HA

SEQ ID NO: 4580 - RNA, 1701 nt, Artificial Sequence
  derived and/or modified CDS sequence (AUadapt) from InfluenzaA__ADD96806__HA
augaaggccauccuggugguccuccuguacacccuggccaccgcgaacgccgacacgcucugcaucggcuaccacgccaacaacucgaccgacaccguggacaccgugcuggagaagaacgucacggugacccacuccgugaaccugcucgaggacaagcacaacgggaagcugugcaagcugcgcggcgucgcgccccuccaccuggggaagugcaacaucgccggcuggauccuggggaacccggagugcgagucgcucuccaccgccagcuccuggucguacaucguggagaccuccagcuccgacaacggcacgugcuaccccggcgacuucaucgacuacgaggagcugcgggagcagcugucguccgugagcuccuucgagcgcuucgagaucuuccccaagaccucguccuggcccaaccacgacucgaacaagggggucaccgccgccugcccgcacgccggcgcgaaguccuucuacaagaaccucaucuggcuggugaagaaggggaacagcuaccccaagcuguccaagucguacaucaacgacaagggcaaggaggugcucguccugugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccucguggagcccggggacaagaucaccuucgaggcgaccggcaaccugguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcuccggcuggcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacagcaacgugaagaaccuguacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcucaaccgggaggagaucgacggcgugaagcuggagagcacccgcaucuaccagauccuggcgaucuacuccaccgucgccucgagccucgugcugguggucucccugggggccaucucguucuggaugugcuccaacggcagccuccagugccggaucugcaucuga

SEQ ID NO: 4581 - RNA, 1701 nt, Artificial Sequence; identical to SEQ ID NO: 4078
  derived and/or modified CDS sequence (AUadapt) from InfluenzaA__ADD96816__HA

SEQ ID NO: 4582 - RNA, 1701 nt, Artificial Sequence
  derived and/or modified CDS sequence (AUadapt) from InfluenzaA__ADD96826__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaaggucauggaccaggagggccggaugaacuacuacuggacccugguggagcccggggacaagaucaccuucgaggcgaccggcaaccucguggucccccgcuacgccuucgccauggagcggaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagucgcgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucgccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacucgaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggcgaagcugaaccgcgaggagaucgacggcgugaagcucgagucgacccggaucuaccagauccuggccaucuacuccaccgucgccagcucgcuggugcucguggucucccugggggccaucagcuucuggaugugcuccaacggcagccugcagugccgcaucugcaucuga

SEQ ID NO: 4583 - RNA, 1701 nt, Artificial Sequence; identical to SEQ ID NO: 116
  derived and/or modified CDS sequence (AUadapt) from InfluenzaA__ADD96836__HA

SEQ ID NO: 4584 - RNA, 1701 nt, Artificial Sequence; identical to SEQ ID NO: 116
  derived and/or modified CDS sequence (AUadapt) from InfluenzaA__ADD96846__HA

SEQ ID NO: 4585 - RNA, 1701 nt, Artificial Sequence; identical to SEQ ID NO: 4466
  derived and/or modified CDS sequence (AUadapt) from InfluenzaA__ADD96856__HA

SEQ ID NO: 4586 - RNA, 1701 nt, Artificial Sequence; identical to SEQ ID NO: 3267
  derived and/or modified CDS sequence (AUadapt) from InfluenzaA__ADD96886__HA

SEQ ID NO: 4587 - RNA, 1701 nt, Artificial Sequence; identical to SEQ ID NO: 4541
  derived and/or modified CDS sequence (AUadapt) from InfluenzaA__ADD96896__HA

SEQ ID NO: 4588 - RNA, 1701 nt, Artificial Sequence; identical to SEQ ID NO: 4078
  derived and/or modified CDS sequence (AUadapt) from InfluenzaA__ADD96906__HA

SEQ ID NO: 4589 - RNA, 1701 nt, Artificial Sequence; identical to SEQ ID NO: 4078
  derived and/or modified CDS sequence (AUadapt) from InfluenzaA__ADD96916__HA

SEQ ID NO: 4590 - RNA, 1701 nt, Artificial Sequence; identical to SEQ ID NO: 4078
  derived and/or modified CDS sequence (AUadapt) from InfluenzaA__ADD96926__HA

SEQ ID NO: 4591 - RNA, 1701 nt, Artificial Sequence
  derived and/or modified CDS sequence (AUadapt) from InfluenzaA__ADD96936__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccagcuccgacaacggcacgugcuaccccggcgacuucaucgacuacgaggagcugcgggagcagcucucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcugaucaagaaggggaacucguaccccaagcucuccaagagcuacaucaacgacaagggcaaggaggugcuggugcugugggggauccaccaccccucgaccuccgccgaccagcagagccucuaccagaacgccgacgccuacgucuucgugggcacgucccgguacucgaagaaguucaagcccgagaucgccauccgcccgaaggugcgggaccaggagggccgcaugaacuacuacuggacccuggucgagcccggggacaagaucaccuucgaggcgaccggcaaccugguggugccccgguacgccuucgccauggagcgcaacgccggguccggcaucaucaucagcgacacgcccguccacgacugcaacacgaccugccagaccccgaagggcgccaucaacaccucccuccccuuccagaacauccaccccaucaccaucgggaagugccccaaguacgucaagucgaccaagcugcggcuggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccuggacaucuggaccuacaacgccgagcuccugguccugcucgagaacgagcggacccuggacuaccacgacagcaacgugaagaaccuguacgagaaggugcgcucccagcucaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcuggagagcacccgcaucuaccagauccucgcgaucuacuccaccguggccucgagccugguccugguggugucccucggggccaucucguucuggaugugcuccaacggcagccugcagugccggaucugcaucuga

SEQ ID NO: 4592 - RNA, 1701 nt, Artificial Sequence
  derived and/or modified CDS sequence (AUadapt) from InfluenzaA__ADD96946__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucaagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucggggagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 4593 - RNA, 1701 nt, Artificial Sequence
  derived and/or modified CDS sequence (AUadapt) from InfluenzaA__ADD96956__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggagcaggagggccgcaugaacuacuacuggacccuggugaagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccacagcaucaccaucgggaagugccccaaguacgugaaguccaccaagcugcggcucgcgaccggccugcgcaacguccccucgauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacucggucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuacccgaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 4594 - RNA, 1701 nt, Artificial Sequence; identical to SEQ ID NO: 116
  derived and/or modified CDS sequence (AUadapt) from InfluenzaA__ADD96976__HA

SEQ ID NO: 4595 - RNA, 1701 nt, Artificial Sequence; identical to SEQ ID NO: 116
  derived and/or modified CDS sequence (AUadapt) from InfluenzaA__ADD96986__HA

SEQ ID NO: 4596 - RNA, 1701 nt, Artificial Sequence
  derived and/or modified CDS sequence (AUadapt) from InfluenzaA__ADD97035__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggauggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcuggagagcacccgcaucuaccagauccucgcgaucuacuccaccgucgccucgagccuggugcugguggucucccucggggccaucucguucuggaugugcuccaacggcagccugcagugccggaucugcaucuga

SEQ ID NO: 4597 - RNA, 1701 nt, Artificial Sequence
  derived and/or modified CDS sequence (AUadapt) from InfluenzaA__ADD97045__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaccgacuacgaggagcuccgggagcagcugucguccgugagcuccuucgagcgcuucgagaucuuccccaagaccucguccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcacguccgccgaccagcagucgcuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccggguccggcaucaucaucucggacacccccgugcacgacugcaacacgaccugccagaccccgaagggcgccaucaacaccucccugcccuuccagaacauccaccccaucaccaucgggaagugccccaaguacgucaagagcaccaagcugcggcucgcgacgggccugcgcaacgugccguccauccagucgcgggggcuguucggcgccaucgccggguucaucgagggcggcuggaccgggaugguggacggcugguacggguaccaccaccagaacgagcagggcuccggguacgccgccgaccucaagucgacccagaacgcgaucgacgagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 4598 - RNA, 1701 nt, Artificial Sequence; identical to SEQ ID NO: 4597
  derived and/or modified CDS sequence (AUadapt) from InfluenzaA__ADD97055__HA

SEQ ID NO: 4599 - RNA, 1701 nt, Artificial Sequence; identical to SEQ ID NO: 4597
  derived and/or modified CDS sequence (AUadapt) from InfluenzaA__ADD97123__HA

SEQ ID NO: 4600 - RNA, 1701 nt, Artificial Sequence
  derived and/or modified CDS sequence (AUadapt) from InfluenzaA__ADD97161__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaagggcaagucguaccccaagcuguccaagagcuacaucaacgacaaggggaagaaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 4601 - RNA, 1701 nt, Artificial Sequence
  derived and/or modified CDS sequence (AUadapt) from InfluenzaA__ADD97171__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccgugucguucuggaugugcuccaacggcagccugcagugccggaucugcaucuga

SEQ ID NO: 4602 - RNA, 1701 nt, Artificial Sequence; identical to SEQ ID NO: 116
  derived and/or modified CDS sequence (AUadapt) from InfluenzaA__ADD97181__HA

SEQ ID NO: 4603 - RNA, 1701 nt, Artificial Sequence; identical to SEQ ID NO: 116
  derived and/or modified CDS sequence (AUadapt) from InfluenzaA__ADD97201__HA

SEQ ID NO: 4604 - RNA, 1701 nt, Artificial Sequence; identical to SEQ ID NO: 4597
  derived and/or modified CDS sequence (AUadapt) from InfluenzaA__ADD97211__HA

SEQ ID NO: 4605 - RNA, 1701 nt, Artificial Sequence; identical to SEQ ID NO: 116
  derived and/or modified CDS sequence (AUadapt) from InfluenzaA__ADD97231__HA

SEQ ID NO: 4606 - RNA, 1701 nt, Artificial Sequence
  derived and/or modified CDS sequence (AUadapt) from InfluenzaA__ADD97241__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaccgacuacgaggagcuccgggagcagcugucguccgugagcuccuucgagcgcuucgagaucuuccccaagaccucguccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcacguccgccgaccagcagucgcuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccggguccggcaucaucaucucggacacccccgugcacaacugcaacacgaccugccagaccccgaagggcgccaucaacaccucccugcccuuccagaacauccaccccaucaccaucgggaagugccccaaguacgucaagagcaccaagcugcggcucgcgacgggccugcgcaacgugccguccauccagucgcgggggcuguucggcgccaucgccggguucaucgagggcggcuggaccgggaugguggacggcugguacggguaccaccaccagaacgagcagggcuccggguacgccgccgaccucaagucgacccagaacgcgaucgacgagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 4607 - RNA, 1701 nt, Artificial Sequence; identical to SEQ ID NO: 4597
  derived and/or modified CDS sequence (AUadapt) from InfluenzaA__ADD97251__HA

SEQ ID NO: 4608 - RNA, 1701 nt, Artificial Sequence; identical to SEQ ID NO: 116
  derived and/or modified CDS sequence (AUadapt) from InfluenzaA__ADD97261__HA

SEQ ID NO: 4609 - RNA, 1701 nt, Artificial Sequence
  derived and/or modified CDS sequence (AUadapt) from InfluenzaA__ADD97271__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucacgccccugcaccucgggaagugcaacaucgccggcuggauccuggggaacccggagugcgagucgcuguccaccgccagcuccuggucguacaucguggagaccuccagcuccgacaacgggaccugcuaccccggcgacuucaucgacuacgaggagcuccgggagcagcugucguccgugagcuccuucgagcgcuucgagaucuuccccaagaccucguccuggcccaaccacgacagcaacaagggcgucaccgcggccugcccgcacgccggcgccaaguccuucuacaagaaccugaucuggcucgugaagaaggggaacucguaccccaagcuguccaagagcuacaucaacgacaagggcaaggaggugcugguccucugggggauccaccaccccucgacguccgcggaccagcagagccuguaccagaacgccgacgccuacguguucgugggcaccucccgguacucgaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcggcucgccacgggccugcgcaacaucccguccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacgagaucaccaacaaggugaacuccgugaucgagaagaugaacacgcaguucaccgcggucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggccaucuacuccaccguggcgucgagccugguccucguggugucccugggggccaucucguucuggaugugcuccaacggcagccugcagugccggaucugcaucuga

SEQ ID NO: 4610 - RNA, 1701 nt, Artificial Sequence; identical to SEQ ID NO: 4601
  derived and/or modified CDS sequence (AUadapt) from InfluenzaA__ADD97281__HA

SEQ ID NO: 4611 - RNA, 1701 nt, Artificial Sequence; identical to SEQ ID NO: 116
  derived and/or modified CDS sequence (AUadapt) from InfluenzaA__ADD97291__HA

SEQ ID NO: 4612 - RNA, 1701 nt, Artificial Sequence
  derived and/or modified CDS sequence (AUadapt) from InfluenzaA__ADD97311__HA
augaaggccauccuggugguccuccuguacaccuucgccaccgcgaacgccgacacgcugugcaucggcuaccacgccaacaacucgaccgacaccguggacaccauccucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagagccuguccaccgccucguccuggagcuacaucgucgagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggugaccgccgccugcccgcacgccggcgcgaaguccuucuacaagaaccugaucuggcucgucaagaaggggaacagcuaccccaagcuguccaagucguacaucaacgacaagggcaaggagauccuggugcucugggggauccaccaccccagcaccaucgccgaccagcagucccuguaccagaacgccgacgccuacguguucgucggcacgucgcgguacuccaagaaguucaagcccgagaucgccauccgcccgaaggugcgggaccaggagggccgcaugaaguacuacuggacccugguggagcccggggacaagaucaccuucgaggcgaccggcaaccucgucgugccccgguacgccuucgccauggagcgcaacgccgggagcggcaucaucaucuccgacacgcccgugcacaacugcaacacgaccugccagaccucgaagggcgccaucaacaccucccugccguuccagaacauccaccccaucaccaucgggaagugccccaaguacgucaagagcaccaagcugcggcucgcgaccggccugcgcaacgugcccuccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggucaacuccgugaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuacccgaaguacuccgaggaggccaagcugaaccgggaggagaucgacggcgucaagcucgagucgacccgcaucuaccagauccuggcgaucuacuccaccguggccagcucgcuggugcucgucgugucccugggggccaucagcuucuggaugugcuccaacggcagccugcagugccggaucugcaucuga

SEQ ID NO: 4613 - RNA, 1701 nt, Artificial Sequence; identical to SEQ ID NO: 4597
  derived and/or modified CDS sequence (AUadapt) from InfluenzaA__ADD97321__HA

SEQ ID NO: 4614 - RNA, 1701 nt, Artificial Sequence; identical to SEQ ID NO: 4078
  derived and/or modified CDS sequence (AUadapt) from InfluenzaA__ADD97331__HA

SEQ ID NO: 4615 - RNA, 1701 nt, Artificial Sequence
  derived and/or modified CDS sequence (AUadapt) from InfluenzaA__ADD97341__HA
augaaggccauccuggugguccuccuguacaccuucgccaccgugaacgcggacacgcugugcaucggcuaccacgccaacaacucgaccgacaccguggacaccguccucgagaagaacgugacggugacccacuccgucaaccugcuggaggacaagcacaacgggaagcucugcaagcugcgcggcguggcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgucucguccuucgagcgcuucgagaucuuccccaagaccagcuccuggcccaaccacgacucgaacaagggggugaccgccgccugcccgcacgccggcgccaaguccuucuacaagaaccugaucuggcucgugaagaaggggaacagcuaccccaagcuguccaagucguacaucaacgacaagggcaaggagguccuggugcucugggggauccaccaccccagcaccuccacggaccagcagucgcuguaccagaacgcggacgccuacguguucgucggcaccucccgguacagcaagaaguucaagcccgagaucgccauccgcccgaaggugcgggaccaggagggccgcaugaacuacuacuggacccugguggagcccggggacaagaucaccuucgaggccacgggcaaccucgucgugccccgguacgccuucgcgauggagcgcaacgccggguccggcaucaucaucucggacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacaucccguccauccagucgcgggggcuguucggcgccaucgcgggguucaucgagggcggcuggaccgggaugguggacggcugguacggguaccaccaccagaacgagcagggcuccggguacgccgccgaccucaagagcacccagaacgccaucgacgagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgacccgcaucuaccagauccuggccaucuacuccaccgucgccagcucgcuggugcucguggucucccugggggcgaucagcuucuggaugugcuccaacggcagccugcagugccggaucugcaucuga

SEQ ID NO: 4616 - RNA, 1701 nt, Artificial Sequence; identical to SEQ ID NO: 4078
  derived and/or modified CDS sequence (AUadapt) from InfluenzaA__ADD97351__HA

SEQ ID NO: 4617 - RNA, 1701 nt, Artificial Sequence; identical to SEQ ID NO: 4078
  derived and/or modified CDS sequence (AUadapt) from InfluenzaA__ADD97361__HA

SEQ ID NO: 4618 - RNA, 1701 nt, Artificial Sequence
  derived and/or modified CDS sequence (AUadapt) from InfluenzaA__ADD97371__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccgggugugcaucuga

SEQ ID NO: 4619 - RNA, 1701 nt, Artificial Sequence; identical to SEQ ID NO: 4078
  derived and/or modified CDS sequence (AUadapt) from InfluenzaA__ADD97381__HA

SEQ ID NO: 4620 - RNA, 1701 nt, Artificial Sequence; identical to SEQ ID NO: 116
  derived and/or modified CDS sequence (AUadapt) from InfluenzaA__ADD97391__HA

SEQ ID NO: 4621 - RNA, 1701 nt, Artificial Sequence; identical to SEQ ID NO: 4078
  derived and/or modified CDS sequence (AUadapt) from InfluenzaA__ADD97411__HA

SEQ ID NO: 4622 - RNA, 1701 nt, Artificial Sequence; identical to SEQ ID NO: 4078
  derived and/or modified CDS sequence (AUadapt) from InfluenzaA__ADD97421__HA

SEQ ID NO: 4623 - RNA, 1701 nt, Artificial Sequence; identical to SEQ ID NO: 116
  derived and/or modified CDS sequence (AUadapt) from InfluenzaA__ADD97431__HA

SEQ ID NO: 4624 - RNA, 1701 nt, Artificial Sequence
  derived and/or modified CDS sequence (AUadapt) from InfluenzaA__ADD97441__HA
augaaggccauccuggugguccuccuguacaccuucgccaccgcgaacgccgacacgcugugcaucggcuaccacgccaacaacucgaccgacaccguggacaccauccucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagucgcuguccaccgccagcuccuggucguacaucgucgagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggugaccgccgccugcccgcacgccggcgcgaaguccuucuacaagaaccugaucuggcucgucaagaaggggaacucguaccccaagcuguccaagagcuacaucaacgacaagggcaaggagauccuggugcucugggggauccaccaccccucgaccuccgccgaccagcagagccuguaccagaacgccgacgccuacguguucgucggcacgucccgguacucgaagaaguucaagcccgagaucgccauccgcccgaaggugcgggaccaggagggccgcaugaacuacuacuggacccugguggagcccggggacaagaucaccuucgaggcgaccggcaaccucgucgugccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggucaacuccgugaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgucaagcucgagagcacccgcaucuaccagauccuggcgaucuacuccaccguggccucgagccuggugcucgucgugucccugggggccaucucguucuggaugugcuccaacggcagccugcagugccggaucugcaucuga

SEQ ID NO: 4625 - RNA, 1701 nt, Artificial Sequence; identical to SEQ ID NO: 4618
  derived and/or modified CDS sequence (AUadapt) from InfluenzaA__ADD97451__HA

SEQ ID NO: 4626 - RNA, 1701 nt, Artificial Sequence; identical to SEQ ID NO: 4618
  derived and/or modified CDS sequence (AUadapt) from InfluenzaA__ADD97461__HA

SEQ ID NO: 4627 - RNA, 1701 nt, Artificial Sequence; identical to SEQ ID NO: 4466
  derived and/or modified CDS sequence (AUadapt) from InfluenzaA__ADD97471__HA

SEQ ID NO: 4628 - RNA, 1701 nt, Artificial Sequence; identical to SEQ ID NO: 4466
  derived and/or modified CDS sequence (AUadapt) from InfluenzaA__ADD97481__HA

SEQ ID NO: 4629 - RNA, 1701 nt, Artificial Sequence
  derived and/or modified CDS sequence (AUadapt) from InfluenzaA__ADD97491__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgaggcgccccugcaccucgggaagugcaacaucgccggcuggauccuggggaacccggagugcgagucgcuguccaccgccagcuccuggucguacaucgucgagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacucgaacaagggggugaccgccgccugcccgcacgccggcgcgaaguccuucuacaagaaccugaucuggcucgucaagaaggggaacagcuaccccaagcuguccaagucguacaucaacgacaagggcaaggaggugcuggugcucugggggauccaccaccccagcaccuccgccgaccagcagucgcuguaccagaacgccgacgccuacgucuucgugggcacgucccgguacagcaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucucggacacgcccguccacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgagccugguccucguggugucccugggggccaucucguucuggaugugcuccaacggcagccugcagugccggaucugcaucuga

SEQ ID NO: 4630 - RNA, 1701 nt, Artificial Sequence; identical to SEQ ID NO: 4629
  derived and/or modified CDS sequence (AUadapt) from InfluenzaA__ADD97501__HA

SEQ ID NO: 4631 - RNA, 1701 nt, Artificial Sequence; identical to SEQ ID NO: 3267
  derived and/or modified CDS sequence (AUadapt) from InfluenzaA__ADD97511__HA

SEQ ID NO: 4632 - RNA, 1701 nt, Artificial Sequence
  derived and/or modified CDS sequence (AUadapt) from InfluenzaA__ADD97531__HA
augaaggccauccuggugguccuccuguacaccuucgccaccgcgaacgccgacacgcugugcaucggcuaccacgccaacaacucgaccgacaccguggacaccauccucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagagccuguccaccgccucguccuggagcuacaucgucgagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggugaccgccgccugcccgcacgccggcgcgaaguccuucuacaagaaccugaucuggcucgucaagaaggggaacagcuaccccaagcuguccaagucguacaucaacgacaagggcaaggagauccuggugcucugggggauccaccaccccagcaccaucgccgaccagcagucccuguaccagaacgccgacgccuacguguucgucggcacgucgcgguacuccaagaaguucaagcccgagaucgccauccgcccgaaggugcgggaccaggagggccgcaugaaguacuacuggacccugguggagcccggggacaagaucaccuucgaggcgaccggcaaccucgucgugccccgguacgccuucgccauggagcgcaacgccgggagcggcaucaucaucuccgacacgcccgugcacaacugcaacacgaccugccagaccccgaagggcgccaucaacaccucgcugcccuuccagaacauccaccccaucaccaucgggaagugccccaaguacgucaaguccaccaagcugcggcucgcgaccggccugcgcaacgugccgagcauccagucccgggggcuguucggcgccaucgccggguucaucgagggcggcuggacggggaugguggacggcugguacggguaccaccaccagaacgagcagggcucgggguacgccgccgaccucaaguccacccagaacgcgaucgacgagaucaccaacaaggucaacagcgugaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgucaagaaccucuacgagaaggugcgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgucaagcucgaguccacccgcaucuaccagauccuggcgaucuacucgaccguggccuccagccuggugcucgucgugucgcugggggccaucuccuucuggaugugcagcaacggcucccugcagugccggaucugcaucuga

SEQ ID NO: 4633 - RNA, 1701 nt, Artificial Sequence
  derived and/or modified CDS sequence (AUadapt) from InfluenzaA__ADD97541__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggucaccgccgccugcccgcacaccggcgccaaguccuucuacaagaaccugaucuggcucgugaagaaggggaacagcuaccccaagcuguccaagucguacaucaacgacaagggcaaggaggugcugguccucugggggauccaccaccccagcacguccaccgaccagcagucgcuguaccagaacgcggacgcccacguguucgugggcaccucccgguacagcaagaaguucaagcccgagaucgccauccgcccgaagguccgggaccaggagggccgcaugaacuacuacuggacccugguggagcccggggacaagaucacguucgaggccaccggcaaccucguggucccccgguacgccuucgcgauggagcgcaacgccggguccggcaucaucaucucggacacccccgugcacgacugcaacaccacgugccagaccccgaagggcgccaucaacaccucccugcccuuccagaacauccaccccaucaccaucgggaagugccccaaguacgucaagagcacgaagcugcggcucgccaccggccugcgcaacaucccguccauccagucgcgggggcuguucggcgccaucgcgggguucaucgagggcggcuggaccgggaugguggacggcugguacggguaccaccaccagaacgagcagggcuccggguacgccgccgaccucaagucgacccagaacgccaucgacgagaucacgaacaaggugaacuccgugaucgagaagaugaacacccaguucaccgccgucggcaaggaguucaaccaccuggagaagcgcaucgagaaccugaacaagaagguggacgacggcuuccucgacaucuggaccuacaacgcggagcugcugguccuccuggagaacgagcggacgcuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggccaucuacuccaccguggccucgagccugguccucguggugucccugggggcgaucucguucuggaugugcuccaacggcagccugcagugccggaucugcaucuga

SEQ ID NO: 4634 - RNA, 1701 nt, Artificial Sequence; identical to SEQ ID NO: 4466
  derived and/or modified CDS sequence (AUadapt) from InfluenzaA__ADD97551__HA

SEQ ID NO: 4635 - RNA, 1701 nt, Artificial Sequence; identical to SEQ ID NO: 4078
  derived and/or modified CDS sequence (AUadapt) from InfluenzaA__ADD97561__HA

SEQ ID NO: 4636 - RNA, 1701 nt, Artificial Sequence
  derived and/or modified CDS sequence (AUadapt) from InfluenzaA__ADD97571__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgucguccuggagcuacaucguggagaccuccucguccgacaacggcacgugcuaccccggcgacuucaucaacuacgaggagcuccgggagcagcugagcuccgugucgcuguucgagcgcuucgagaucuuccccaagaccuccagcuggcccaaccacgacuccaacaagggggucaccgccgccugcccgcacgccggcgccaagucguucuacaagaaccucaucuggcuggugaagaaggggaacuccuaccccaagcugagcaaguccuacaucaacgacaagggcaaggaggugcucguccugugggggauccaccaccccucgaccagcgccgaccagcagucccuguaccagaacgccgacgccuacguguucgugggcacgucgcgguacuccaagaaguucaagcccgagaucgccauccgcccgaagguccgggaccaggagggccgcaugaacuacuacuggacccucguggagcccggggacaagaucaccuucgaggcgaccggcaaccugguggucccccgguacgccuucgccauggagcgcaacgccgggagcggcaucaucaucuccgacacgcccgugcacgacugcaacacgaccugccagaccccgaagggcgccaucaacaccucgcugcccuuccagaacauccaccccaucaccaucgggaagugccccaaguacgugaaguccaccaagcuccggcuggcgaccggccugcgcaacgucccgagcauccagucccggggccucuucggggccaucgccggguucaucgagggcggcuggacggggaugguggacggcugguacggguaccaccaccagaacgagcagggcucgggguacgccgccgaccugaaguccacccagaacgcgaucgacaagaucaccaacaaggugaacagcgucaucgagaagaugaacacccaguucacggccgugggcaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacuccaacgugaagaaccuguacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcucaaccgggaggagaucgacggcgugaagcuggaguccacccgcaucuaccagauccuggcgaucuacucgaccgucgccuccagccucgugcugguggucucgcugggggccaucuccuucuggaugugcagcaacggcucccuccagugccggaucugcaucuga

SEQ ID NO: 4637 - RNA, 1701 nt, Artificial Sequence; identical to SEQ ID NO: 116
  derived and/or modified CDS sequence (AUadapt) from InfluenzaA__ADD97581__HA

SEQ ID NO: 4638 - RNA, 1701 nt, Artificial Sequence; identical to SEQ ID NO: 116
  derived and/or modified CDS sequence (AUadapt) from InfluenzaA__ADD97591__HA

SEQ ID NO: 4639 - RNA, 1701 nt, Artificial Sequence; identical to SEQ ID NO: 116
  derived and/or modified CDS sequence (AUadapt) from InfluenzaA__ADD97688__HA

SEQ ID NO: 4640 - RNA, 1701 nt, Artificial Sequence; identical to SEQ ID NO: 4466
  derived and/or modified CDS sequence (AUadapt) from InfluenzaA__ADD97698__HA

SEQ ID NO: 4641 - RNA, 1701 nt, Artificial Sequence; identical to SEQ ID NO: 4466
  derived and/or modified CDS sequence (AUadapt) from InfluenzaA__ADD97888__HA

SEQ ID NO: 4642 - RNA, 1701 nt, Artificial Sequence
  derived and/or modified CDS sequence (AUadapt) from InfluenzaA__ADD97898__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccacggaccagcagagccuguaccagaacgccgacgccuacguguucgugggcaccucccgguacucgaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcggcucgccacgggccugcgcaacaucccguccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacgagaucaccaacaaggugaacuccgugaucgagaagaugaacacgcaguucaccgcggucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggccaucuacuccaccguggcgucgagccugguccucguggugucccugggggccaucucguucuggaugugcuccaacggcagccugcagugccggaucugcaucuga

SEQ ID NO: 4643 - RNA, 1701 nt, Artificial Sequence; identical to SEQ ID NO: 3267
  derived and/or modified CDS sequence (AUadapt) from InfluenzaA__ADD97908__HA

SEQ ID NO: 4644 - RNA, 1701 nt, Artificial Sequence; identical to SEQ ID NO: 4078
  derived and/or modified CDS sequence (AUadapt) from InfluenzaA__ADD97918__HA

SEQ ID NO: 4645 - RNA, 1701 nt, Artificial Sequence
  derived and/or modified CDS sequence (AUadapt) from InfluenzaA__ADD97928__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccggcaacggcacgugcuaccccggggacuucaucgacuacgaggagcuccgggagcagcugucguccgugagcuccuucgagcgcuucgagaucuuccccaagaccucguccuggcccaaccacgacucgaacaagggcgucaccgccgccugcccgcacgccggggcgaaguccuucuacaagaaccugaucuggcucgugaagaagggcaacagcuaccccaagcuguccaagucguacaucaacgacaaggggaaggaggugcugguccucuggggcauccaccaccccagcaccuccgccgaccagcagucgcuguaccagaacgccgacgccuacguguucgugggcacgucccgguacagcaagaaguucaagcccgagaucgccauccgcccgaagguccgggaccaggaggggcgcaugaacuacuacuggacccugguggagcccggcgacaagaucaccuucgaggcgaccgggaaccucguggucccccgguacgccuucgccauggagcgcaacgccggcuccggcaucaucaucucggacacgcccgugcacgacugcaacacgaccugccagaccccgaagggggccaucaacaccucccugcccuuccagaacauccaccccaucaccaucggcaagugccccaaguacgucaagagcaccaagcugcggcucgcgaccgggcugcgcaacgugccguccauccagucgcggggccuguucggggccaucgccggcuucaucgagggcggguggacgggcaugguggacgggugguacggcuaccaccaccagaacgagcagggguccggcuacgccgccgaccucaagucgacccagaacgcgaucgacggcaucaccaacaaggugaacuccgucaucgagaagaugaacacccaguucacggccguggggaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguuccaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggcgccaucucguucuggaugugcuccaacgggagccugcagugccggaucugcaucuga

SEQ ID NO: 4646 - RNA, 1701 nt, Artificial Sequence
  derived and/or modified CDS sequence (AUadapt) from InfluenzaA__ADD97938__HA
augaaggccauccuggugguccuccuguacaccuucgccaccgcgaacgccgacacgcugugcaucggcuaccacgccaacaacucgaccgacaccguggacaccauccucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagagccuguccaccgccucguccuggagcuacaucgucgagaccuccucguccgacaacggcacgugcuaccccggcgacuucaucgacuacgaggagcuccgggagcagcugagcuccgugucguccuucgagcgcuucgagaucuuccccaugaccagcuccuggcccaaccacgacucgaacaagggggugaccgccgccugcccgcacgccggcgcgaaguccuucuacaagaaccugaucuggcucgucaagaaggggaacagcuaccccaagcuguccaagucguacaucaacgacaagggcaaggagauccuggugcucugggggauccaccaccccagcaccuccgccgaccagcagucgcuguaccagaacgccgacgccuacguguucgucggcacgucccgguacagcaagaaguucaagcccgagaucgccauccgcccgaaggugcgggaccaggagggccgcaugaacuacuacuggacccugguggagcccggggacaagaucaccuucgaggcgaccggcaaccucgucgugccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggucaacuccgugaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagucgacccgcaucuaccagauccuggcgaucuacuccaccguggccagcucgcuggugcucgucgugucccugggggccaucagcuucuggaugugcuccaacggcagccugcagugccggaucugcaucuga

SEQ ID NO: 4647 - RNA, 1701 nt, Artificial Sequence
  derived and/or modified CDS sequence (AUadapt) from InfluenzaA__ADD97948__HA
augaaggccauccugcucgugcugcuguacaccuucgccaccgcgaacgccgacacgcucugcaucggcuaccacgccaacaacucgaccgacaccgucgacaccgugcuggagaagaacgugacggucacccacuccgugaaccugcucgaggacaagcacaacgggaagcugugcaagcugcgcggcguggcgccccuccaccuggggaagugcaacaucgccggcuggauccuggggaacccggagugcgagucgcucuccaccgccagcuccuggucguacaucgucgagaccuccagcuccgacaacggcacgugcuaccccggcgacuucaucgacuacgaggagcugcgggagcagcugucguccgugagcuccuucgagcgcuucgagauguuccccaagaccucguccuggcccaaccacgacagcaacaagggggugaccgccgccugcccgcacgccggcgcgaaguccuucuacaagaaccucaucuggcuggucaagaaggggaacucguaccccaagcuguccaagagcuacaucaacgacaagggcaaggaggugcucgugcugugggggauccaccaccccucgaccuccgccgaccagcagagccuguaccagaacgccgacgccuacgucuucgugggcacgucccgguacucgaagaaguucaagcccgagaucgccauccgcccgaaggugcgggaccaggagggccgcaugaacuacuacuggacccucgucgagcccggggacaagaucaccuucgaggcgaccggcaaccugguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagucgaccaagcuccggcuggcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgugaucgagaagaugaacacccaguucacggccgucggcaaggaguucaaccaccuggagaagcgcaucgagaaccucaacaagaagguggacgacggcuuccuggacaucuggaccuacaacgccgagcugcucguccugcuggagaacgagcggacccucgacuaccacgacagcaacgugaagaaccuguacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcucaaccgggaggagaucgacggcgugaagcuggagagcacccgcaucuaccagauccuggcgaucuacuccaccguggccucgagccucguccugguggugucccugggggccaucucguucuggaugugcuccaacggcagccuccagugccggaucugcaucuga

SEQ ID NO: 4648 - RNA, 1701 nt, Artificial Sequence
  derived and/or modified CDS sequence (AUadapt) from InfluenzaA__ADD97958__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguuccagcccgagaucgccauccgcccgaagguccgggaccaggagggccgcaugaacuacuacuggacccugcucgagcccggggacaagaucaccuucgaggcgaccggcaaccugguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagucgaccaagcuccggcuggcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgugaucgagaagaugaacacccaguucacggccgucggcaaggaguucaaccaccuggagaagcgcaucgagaaccucaacaagaagguggacgacggcuuccuggacaucuggaccuacaacgccgagcugcucguccugcuggagaacgagcggacccucgacuaccacgacagcaacgugaagaaccuguacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcucaaccgggaggagaucgacggcgugaagcuggagagcacccgcaucuaccagauccuggcgaucuacuccaccguggccucgagccucguccugguggugucccugggggccaucucguucuggaugugcuccaacggcagccuccagugccggaucugcaucuga

SEQ ID NO: 4649 - RNA, 1701 nt, Artificial Sequence; identical to SEQ ID NO: 116
  derived and/or modified CDS sequence (AUadapt) from InfluenzaA__ADD97968__HA

SEQ ID NO: 4650 - RNA, 1701 nt, Artificial Sequence; identical to SEQ ID NO: 4642
  derived and/or modified CDS sequence (AUadapt) from InfluenzaA__ADD97978__HA

SEQ ID NO: 4651 - RNA, 1701 nt, Artificial Sequence; identical to SEQ ID NO: 4596
  derived and/or modified CDS sequence (AUadapt) from InfluenzaA__ADD97988__HA

SEQ ID NO: 4652 - RNA, 1701 nt, Artificial Sequence
  derived and/or modified CDS sequence (AUadapt) from InfluenzaA__ADD97998__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaaggccucguccuggcccaaccacgacagcaacaagggggucaccgccgccugcccgcacgcgggcgccaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcaccucccgguacucgaagaaguucaagcccgagaucgcgauccgcccgaagguccgggaccaggagggccgcaugaacuacuacuggacgcugguggagcccggggacaagaucaccuucgaggccaccggcaaccucguggucccccgguacgccuucgagauggagcgcaacgccggguccggcaucaucaucagcgacacccccgugcacgacugcaacacgaccugccagaccccgaagggcgccaucaacaccucccugcccuuccagaacauccaccccaucacgaucgggaagugccccaaguacgucaagucgaccaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagucgacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 4653 - RNA, 1701 nt, Artificial Sequence; identical to SEQ ID NO: 4466
  derived and/or modified CDS sequence (AUadapt) from InfluenzaA__ADD98008__HA

SEQ ID NO: 4654 - RNA, 1701 nt, Artificial Sequence
  derived and/or modified CDS sequence (AUadapt) from InfluenzaA__ADD98018__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggagauccuggugcucugggggauccaccaccccucgaccuccgccgaccagcagagccuguaccagaacgccgacgccuacgucuucgugggcacgucccgguacucgaagaaguucaagcccgagaucgccacccgcccgaaggugcgggagcaggagggccgcaugaacuacuacuggacccuggucgagcccggggacaagaucaccuucgaggcgacgggcaaccucguggugccccgguacgccuucgccauggagcgcaacgccggguccggcaucaucaucagcgacacccccguccacgacugcaacacgaccugccagaccccgaagggcgccaucaacaccucccugcccuuccagaacauccacucgaucaccaucgggaagugccccaaguacgugaaguccaccaagcugcggcucgcgacgggccugcgcaacgugcccagcauccagucccgggggcuguucggcgccaucgccggguucaucgagggcggcuggaccgggauggucgacggcugguacggguaccaccaccagaacgagcagggcucgggguacgccgccgaccucaaguccacccagaacgcgaucgacgagaucaccaacaaggugaacagcgugaucgagaagaugaacacgcaguucaccgccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcucgcagcugaagaacaacgccaaggagaucgggaacggcugcuucgaguucuaccacaagugcgacaacacgugcauggaguccgucaagaacgggaccuacgacuacccgaaguacagcgaggaggccaagcugaaccgggaggagaucgacggcgugaagcucgaguccacccgcaucuaccagauccuggcgaucuacucgaccguggccagcucccugguccucguggugucgcugggggccaucuccuucuggaugugcagcaacggcucccugcagugccggaucugcaucuga

SEQ ID NO: 4655 - RNA, 1701 nt, Artificial Sequence; identical to SEQ ID NO: 4618
  derived and/or modified CDS sequence (AUadapt) from InfluenzaA__ADD98028__HA

SEQ ID NO: 4656 - RNA, 1701 nt, Artificial Sequence
  derived and/or modified CDS sequence (AUadapt) from InfluenzaA__ADD98038__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgaucuccaccgccagcuccuggucguacaucguggagaccuccagcuccgacaacggcacgugcuaccccggcgacuucaucgacuacgaggagcugcgggagcagcucucguccgugagcuccuucgagcgcuucgagaucuuccccaaggccucguccuggcccaaccacgacagcaacaagggggucaccgccgccugcccgcacgcgggcgccaaguccuucuacaagaaccugaucuggcuggugaagaaggggaacucguaccccaagcucuccaagagcuacaucaacgacaagggcaaggaggugcugguccugugggggauccaccaccccucgaccuccgccgaccagcagagccucuaccagaacgccgacgccuacguguucgugggcaccucccgguacucgaagaaguucaagcccgagaucgcgauccgcccgaagguccgggaccaggagggccgcaugaacuacuacuggacgcugguggagcccggggacaagaucaccuucgaggccaccggcaaccugguggucccccgguacgccuucgagauggagcgcaacgccggguccggcaucaucaucagcgacacccccgugcacgacugcaacacgaccugccagaccccgaagggcgccaucaacaccucccuccccuuccagaacauccaccccaucacgaucgggaagugccccaaguacgucaagucgaccaagcugcggcuggcgaccggccuccgcaacgugccguccauccagagccgggggcuguucggcgccaucgccggguucaucgagggcggcuggaccgggaugguggacggcugguacggguaccaccaccagaacgagcagggcuccggguacgccgccgaccucaagucgacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccuggacaucuggacguacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcuggagagcacccgcaucuaccagauccucgcgaucuacuccaccgucgccucgagccuggugcugguggucucccucggggccaucucguucuggaugugcuccaacggcagccugcagugccggaucugcaucuga

SEQ ID NO: 4657 - RNA, 1701 nt, Artificial Sequence; identical to SEQ ID NO: 4642
  derived and/or modified CDS sequence (AUadapt) from InfluenzaA__ADD98048__HA

SEQ ID NO: 4658 - RNA, 1701 nt, Artificial Sequence; identical to SEQ ID NO: 116
  derived and/or modified CDS sequence (AUadapt) from InfluenzaA__ADD98058__HA

SEQ ID NO: 4659 - RNA, 1701 nt, Artificial Sequence; identical to SEQ ID NO: 116
  derived and/or modified CDS sequence (AUadapt) from InfluenzaA__ADD98068__HA

SEQ ID NO: 4660 - RNA, 1701 nt, Artificial Sequence; identical to SEQ ID NO: 3156
  derived and/or modified CDS sequence (AUadapt) from InfluenzaA__ADD98078__HA

SEQ ID NO: 4661 - RNA, 1701 nt, Artificial Sequence
  derived and/or modified CDS sequence (AUadapt) from InfluenzaA__ADD98098__HA
augaaggccauccuggugguccuccuguacaccuucgccaccgcgaacgccgacacgcugugcaucggcuaccacgccaacaacucgaccgacaccguggacaccauccucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagagccuguccaccgccucguccuggagcuacaucgucgagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggugaccgccgccugcccgcacgccggcgcgaaguccuucuacaagaaccugaucuggcucgucaagaaggggaacagcuaccccaagcuguccaagucguacaucaacgacaagggcaaggaggugcuggugcucugggggauccaccaccccagcaccuccucggaccagcagucccuguaccagaacgccgacgccuacgucuucgugggcacgagccgguacuccaagaaguucaagcccgagaucgccauccgcccgaaggugcgggaccaggagggccgcaugaacuacuacuggacccuggucgagcccggggacaagaucaccuucgaggccaccggcaaccucguggugccccgguacgcguucgccgucgagcgcaacgccgggucgggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgccaccggccugcgcaacgucccgucgauccagucccgggggcuguucggcgcgaucgccggguucaucgagggcggcuggacggggaugguggacggcugguacggguaccaccaccagaacgagcagggcagcggguacgccgccgaccucaaguccacccagaacgccaucgacgagaucaccaacaaggugaacucggucaucgagaagaugaacacccaguucacggcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggccaucuacagcaccgucgcgucgucccuggugcucguggucagccugggggccaucuccuucuggaugugcagcaacggcucccugcagugccggaucugcaucuga

SEQ ID NO: 4662 - RNA, 1701 nt, Artificial Sequence; identical to SEQ ID NO: 4629
  derived and/or modified CDS sequence (AUadapt) from InfluenzaA__ADD98118__HA

SEQ ID NO: 4663 - RNA, 1701 nt, Artificial Sequence; identical to SEQ ID NO: 4629
  derived and/or modified CDS sequence (AUadapt) from InfluenzaA__ADD98128__HA

SEQ ID NO: 4664 - RNA, 1701 nt, Artificial Sequence
  derived and/or modified CDS sequence (AUadapt) from InfluenzaA__ADD98138__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccacggaccagcagagccuguaccagaacgccgacgccuacguguucgugggcaccucccgguacucgaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacaccggguccggcaucaucaucagcgacacccccgugcacgacugcaacaccacgugccagaccccgaacggcgccaucaacaccucccugcccuuccagaacauccaccccaucaccaucgggaagugccccaaguacgucaagucgacgaagcugcggcucgccaccggccugcgcaacgugccguccauccagagccgggggcuguucggcgccaucgcgggguucaucgagggcggcuggaccgggaugguggacggcugguacggguaccaccaccagaacgagcagggcuccggguacgccgccgaccucaagucgacccagaacgccaucgacaagaucacgaacaaggugaacuccgucaucgagaagaugaacacccaguucaccgccgugggcaaggaguucaaccaccuggagaagcgcaucgagaaccugaacaagaaggucgacgacggcuuccucgacaucuggaccuacaacgcggagcugcuggugcuccuggagaacgagcggacgcuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggccaucuacuccaccgucgccucgagccuggugcucguggucucccugggggcgaucucguucuggaugugcuccaacggcagccugcagugccggaucugcaucuga

SEQ ID NO: 4665 - RNA, 1701 nt, Artificial Sequence
  derived and/or modified CDS sequence (AUadapt) from InfluenzaA__ADD98148__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucuucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgacccgcaucuaccagauccuggcgaucuacuccaccgucgccagcucgcuggugcucguggucucccugggggccaucagcuucuggaugugcuccaacggcagccugcagugccggaucugcaucuga

SEQ ID NO: 4666 - RNA, 1701 nt, Artificial Sequence
  derived and/or modified CDS sequence (AUadapt) from InfluenzaA__ADD98158__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcgagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucgugaucccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgagccugguccucguggugucccugggggccaucucguucuggaugugcuccaacggcagccugcagugccggaucugcaucuga

SEQ ID NO: 4667 - RNA, 1701 nt, Artificial Sequence
  derived and/or modified CDS sequence (AUadapt) from InfluenzaA__ADD98168__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccaucaacauccuggaggacaagcacaacgggaagcugugcaagcuccgcggcguggcgccccugcaccuggggaagugcaacaucgccggcuggauccucgggaacccggagugcgagucgcuguccaccgccagcuccuggucguacaucgucgagaccuccagcuccgacaacggcacgugcuaccccggcgacuucaucgacuacgaggagcugcgggagcagcucucguccgugagcuccuucgagcgcuucgagaucuuccccaagaccucguccuggcccaaccacgacagcaacaagggggugaccgccgccugcccgcacgccggcgcgaaguccuucuacaagaaccugaucuggcuggucaagaaggggaacucguaccccaagcucuccaagagcuacaucaacgacaagggcaaggaggugcuggugcugugggggauccaccaccccucgaccuccgccgaccagcagagccucuaccagaacgccgacgccuacgucuucgugggcacgucccgguacucgaagaaguucaagcccgagaucgccauccgcccgaaggugcgggaccaggagggccgcaugaacuacuacuggacccuggucgagcccggggacaagaucaccuucgaggcgaccggcaaccugguggugcccaaguacgccuucgccauggagcggaacgccggguccggcaucaucaucagcgacacgcccguccacgacugcaacacgaccugccagaccccgaagggcgccaucaacaccucccuccccuuccagaacauccaccccaucaccaucgggaagugccccaaguacgucaagucgaccaagcugcgccuggcgaccggccuccggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgugaucgagaagaugaacacccaguucacggccgucggcaaggaguucaaccaccuggagaagcggaucgagaaccugaacaagaagguggacgacggcuuccuggacaucuggaccuacaacgccgagcuccugguccugcucgagaacgagcgcacccuggacuaccacgacagcaacgugaagaaccuguacgagaaggugcggucccagcucaagaacaacgccaaggagaucgggaacggcugcuucgaguucuaccacaagugcgacaacacgugcauggagucggucaagaacgggaccuacgacuaccccaaguacuccgaggaggccaagcugaaccgcgaggagaucgacggcgugaagcuggagagcacccggaucuaccagauccucgcgaucuacuccaccguggccucgagccugguccugguggugucccucggggccaucucguucuggaugugcuccaacggcagccugcagugccgcaucugcaucuga

SEQ ID NO: 4668 - RNA, 1701 nt, Artificial Sequence; identical to SEQ ID NO: 4086
  derived and/or modified CDS sequence (AUadapt) from InfluenzaA__ADD98188__HA

SEQ ID NO: 4669 - RNA, 1701 nt, Artificial Sequence
  derived and/or modified CDS sequence (AUadapt) from InfluenzaA__ADD98198__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagaugcggcuggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcuggagagcacccgcaucuaccagauccucgcgaucuacuccaccgucgccucgagccuggugcugguggucucccucggggccaucucguucuggaugugcuccaacggcagccugcagugccggaucugcaucuga

SEQ ID NO: 4670 - RNA, 1701 nt, Artificial Sequence; identical to SEQ ID NO: 116
  derived and/or modified CDS sequence (AUadapt) from InfluenzaA__ADD98208__HA

SEQ ID NO: 4671 - RNA, 1701 nt, Artificial Sequence; identical to SEQ ID NO: 96
  derived and/or modified CDS sequence (AUadapt) from InfluenzaA__ADE20321__HA

SEQ ID NO: 4672 - RNA, 1701 nt, Artificial Sequence; identical to SEQ ID NO: 96
  derived and/or modified CDS sequence (AUadapt) from InfluenzaA__ADE20331__HA

SEQ ID NO: 4673 - RNA, 1701 nt, Artificial Sequence; identical to SEQ ID NO: 96
  derived and/or modified CDS sequence (AUadapt) from InfluenzaA__ADE20341__HA

SEQ ID NO: 4674 - RNA, 1701 nt, Artificial Sequence; identical to SEQ ID NO: 4502
  derived and/or modified CDS sequence (AUadapt) from InfluenzaA__ADE20351__HA

SEQ ID NO: 4675 - RNA, 1701 nt, Artificial Sequence; identical to SEQ ID NO: 96
  derived and/or modified CDS sequence (AUadapt) from InfluenzaA__ADE20375__HA

SEQ ID NO: 4676 - RNA, 1701 nt, Artificial Sequence; identical to SEQ ID NO: 4502
  derived and/or modified CDS sequence (AUadapt) from InfluenzaA__ADE20388__HA

SEQ ID NO: 4677 - RNA, 1701 nt, Artificial Sequence; identical to SEQ ID NO: 96
  derived and/or modified CDS sequence (AUadapt) from InfluenzaA__ADE20628__HA

SEQ ID NO: 4678 - RNA, 1701 nt, Artificial Sequence; identical to SEQ ID NO: 4502
  derived and/or modified CDS sequence (AUadapt) from InfluenzaA__ADE20638__HA

SEQ ID NO: 4679 - RNA, 1701 nt, Artificial Sequence; identical to SEQ ID NO: 96
  derived and/or modified CDS sequence (AUadapt) from InfluenzaA__ADE20648__HA

SEQ ID NO: 4680 - RNA, 1701 nt, Artificial Sequence; identical to SEQ ID NO: 96
  derived and/or modified CDS sequence (AUadapt) from InfluenzaA__ADE20658__HA

SEQ ID NO: 4681 - RNA, 1701 nt, Artificial Sequence; identical to SEQ ID NO: 4502
  derived and/or modified CDS sequence (AUadapt) from InfluenzaA__ADE20668__HA

SEQ ID NO: 4682 - RNA, 1701 nt, Artificial Sequence; identical to SEQ ID NO: 4502
  derived and/or modified CDS sequence (AUadapt) from InfluenzaA__ADE20678__HA

SEQ ID NO: 4683 - RNA, 1701 nt, Artificial Sequence; identical to SEQ ID NO: 96
  derived and/or modified CDS sequence (AUadapt) from InfluenzaA__ADE20688__HA

SEQ ID NO: 4684 - RNA, 1701 nt, Artificial Sequence; identical to SEQ ID NO: 96
  derived and/or modified CDS sequence (AUadapt) from InfluenzaA__ADE20708__HA

SEQ ID NO: 4685 - RNA, 1701 nt, Artificial Sequence; identical to SEQ ID NO: 96
  derived and/or modified CDS sequence (AUadapt) from InfluenzaA__ADE20718__HA

SEQ ID NO: 4686 - RNA, 1701 nt, Artificial Sequence
  derived and/or modified CDS sequence (AUadapt) from InfluenzaA__ADE20728__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcucaagggcgucgcgccccugcaccuggggaagugcaacaucgccggcuggauccucgggaacccggagugcgagagccuguccaccgccucguccuggagcuacaucguggagaccuccucguccgacaacggcacgugcuaccccggcgacuucaucgacuacgaggagcugcgcgagcagcucagcuccgugucguccuucgagcgguucgagaucuuccccaagaccagcuccuggcccaaccacgacucgaacaagggggucaccgccgccugcccgcacgccggcgcgaaguccuucuacaagaaccugaucuggcuggugaagaaggggaacagcuaccccaagcucuccaagucguacaucaacgacaagggcaaggaggugcugguccugugggggauccaccaccccagcaccuccgccgaccagcagucgcucuaccagaacgccgacgccuacguguucgugggcuccagcaaguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggucgggcaucaucaucuccgacacccccgugcacgacugcaacacgaccugccagaccccgaagggcgccaucaacaccagccuccccuuccagaacauccaccccaucacgaucgggaagugccccaaguacgugaaguccaccaagcugcggcuggcgaccggccuccgcaacgucccgucgauccagucccgggggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacucggucaucgagaagaugaacacccaguucaccgccgugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcuggaguccacccgcaucuaccagauccucgcgaucuacagcaccgucgccucgucccuggugcugguggucagccucggggccaucuccuucuggaugugcagcaacggcucccugcagugccggaucugcaucuga

SEQ ID NO: 4687 - RNA, 1701 nt, Artificial Sequence; identical to SEQ ID NO: 96
  derived and/or modified CDS sequence (AUadapt) from InfluenzaA__ADE20738__HA

SEQ ID NO: 4688 - RNA, 1701 nt, Artificial Sequence; identical to SEQ ID NO: 96
  derived and/or modified CDS sequence (AUadapt) from InfluenzaA__ADE20748__HA

SEQ ID NO: 4689 - RNA, 1701 nt, Artificial Sequence; identical to SEQ ID NO: 4686
  derived and/or modified CDS sequence (AUadapt) from InfluenzaA__ADE20758__HA

SEQ ID NO: 4690 - RNA, 1701 nt, Artificial Sequence; identical to SEQ ID NO: 96
  derived and/or modified CDS sequence (AUadapt) from InfluenzaA__ADE20768__HA

SEQ ID NO: 4691 - RNA, 1701 nt, Artificial Sequence
  derived and/or modified CDS sequence (AUadapt) from InfluenzaA__ADE20778__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcucaagggcgucgcgccccugcaccuggggaagugcaacaucgccggcuggauccucgggaacccggagugcgagagccuguccaccgccucguccuggagcuacaucguggagaccuccucguccgacaacggcacgugcuaccccggcgacuucaucgacuacgaggagcugcgcgagcagcucagcuccgugucguccuucgagcgguucgagaucuuccccaagaccagcuccuggcccaaccacgacucgaacaagggggucaccgccgccugcccgcacgccggcgcgaaguccuucuacaagaaccugaucuggcuggugaagaaggggaacagcuaccccaagcucuccaagucguacaucaacgacaagggcaagaaggugcugguccugugggggauccaccaccccagcaccuccgccgaccagcagucgcucuaccagaacgccgacgccuacguguucgugggcuccagcaaguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggucgggcaucaucaucuccgacacccccgugcacgacugcaacacgaccugccagaccccgaagggcgccaucaacaccagccuccccuuccagaacauccaccccaucacgaucgggaagugccccaaguacgugaaguccaccaagcugcggcuggcgaccggccuccgcaacgucccgucgauccagucccgggggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacucggucaucgagaagaugaacacccaguucaccgccgugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcuggaguccacccgcaucuaccagauccucgcgaucuacagcaccgucgccucgucccuggugcugguggucagccucggggccaucuccuucuggaugugcagcaacggcucccugcagugccggaucugcaucuga

SEQ ID NO: 4692 - RNA, 1701 nt, Artificial Sequence; identical to SEQ ID NO: 4078
  derived and/or modified CDS sequence (AUadapt) from InfluenzaA__ADE20788__HA

SEQ ID NO: 4693 - RNA, 1701 nt, Artificial Sequence
  derived and/or modified CDS sequence (AUadapt) from InfluenzaA__ADE20808__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaaggagaaggaggugcugguccucuggggcauccaccaccccucgaccuccgccgaccagcagagccuguaccagaacgccgacgccuacguguucguggggacgucccgguacucgaagaaguucaagcccgagaucgccauccgcccgaagguccgggaccaggagggccgcaugaacuacuacuggacccugguggagcccggcgacaagaucaccuucgaggcgaccgggaaccucguggucccccgguacgccuucgccauggagcgcaacgccggcuccgggaucaucaucagcgacacgcccgugcacgacugcaacacgaccugccagaccccgaagggcgccaucaacaccucccugcccuuccagaacauccaccccaucaccaucggcaagugccccaaguacgucaagucgaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagucgacccagaacgcgaucgacaagaucaccaacaaggugaacuccgucaucgagaagaugaacacccaguucacggccguggggaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcucgagagcacccgcaucuaccagauccuggcgaucuacuccaccgucgccucgagccuggugcucguggucucccugggcgccaucucguucuggaugugcuccaacgggagccugcagugccggaucugcaucuga

SEQ ID NO: 4694 - RNA, 1701 nt, Artificial Sequence; identical to SEQ ID NO: 4078
  derived and/or modified CDS sequence (AUadapt) from InfluenzaA__ADE20818__HA

SEQ ID NO: 4695 - RNA, 1701 nt, Artificial Sequence; identical to SEQ ID NO: 4636
  derived and/or modified CDS sequence (AUadapt) from InfluenzaA__ADE20828__HA

SEQ ID NO: 4696 - RNA, 1701 nt, Artificial Sequence
  derived and/or modified CDS sequence (AUadapt) from InfluenzaA__ADE20848__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugaucgacggcugguacggguaccaccaccagaacgagcagggcuccggguacgccgccgaccucaagucgacccagaacgcgaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgagccugguccucguggugucccugggggccaucucguucuggaugugcuccaacggcagccugcagugccggaucugcaucuga

SEQ ID NO: 4697 - RNA, 1701 nt, Artificial Sequence; identical to SEQ ID NO: 4078
  derived and/or modified CDS sequence (AUadapt) from InfluenzaA__ADE20858__HA

SEQ ID NO: 4698 - RNA, 1701 nt, Artificial Sequence
  derived and/or modified CDS sequence (AUadapt) from InfluenzaA__ADE20868__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggggaagcacaacggcaagcucugcaagcugcgcggggucgcgccccugcaccucggcaagugcaacaucgccggguggauccugggcaacccggagugcgagucgcugaccaccgcguccagcugguccuacaucguggagacgucguccagcgacaacgggaccugcuaccccggcgacuucaucgacuacgaggagcuccgggagcagcuguccucgguguccagcuucgagcgcuucgagauguuccccaagaccuccucguggcccaaccacgacuccaacaagggcgucaccgccgccugcccgcacgccggggccaagagcuucuacaagaaccugaucuggcucgugaagaagggcaacuccuaccccaagcugucgaaguccuacaucaacgacaaggggaaggaggugcugguccucuggggcauccaccaccccagcacgucggccgaccagcagucccuguaccagaacgccgacgccuacguguucgugggcaccucgcgguacuccaagaaguucaagcccgagaucgccauccgcccgaagguccgggaccaggaggggcgcaugaacuacuacuggacccugguggagcccggcgacaagaucaccuucgaggcgacggggaaccucguggucccccgguacgccuucgccauggagcgcaacgccggcagcggcaucaucaucuccgacacccccgugcacgacugcaacacgaccugccagaccccgaagggggccaucaacaccucgcugcccuuccagaacauccaccccaucaccaucggcaagugccccaaguacgugaaguccaccaagcugcggcucgcgacggggcugcgcaacgucccgagcauccagucccggggccuguucggggccaucgccggcuucaucgagggcggguggaccggcaugguggacgggugguacggcuaccaccaccagaacgagcaggggucgggcuacgccgccgaccucaaguccacccagaacgcgaucgacgagaucaccaacaaggugaacagcgucaucgagaagaugaacacgcaguucaccgccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcaucuaccagauccuggcgaucuacucgaccgucgccuccagccuggugcucguggucucgcugggcgccaucuccuucuggaugugcagcaacggcucccugcagugccggaucugcaucuga

SEQ ID NO: 4699 - RNA, 1701 nt, Artificial Sequence; identical to SEQ ID NO: 4632
  derived and/or modified CDS sequence (AUadapt) from InfluenzaA__ADE20878__HA

SEQ ID NO: 4700 - RNA, 1701 nt, Artificial Sequence; identical to SEQ ID NO: 4016
  derived and/or modified CDS sequence (AUadapt) from InfluenzaA__ADE20888__HA

SEQ ID NO: 4701 - RNA, 1701 nt, Artificial Sequence
  derived and/or modified CDS sequence (AUadapt) from InfluenzaA__ADE20898__HA
augaaggccauccuggugguccuccuguacaccuucgccaccgcgaacgccgacacgcugugcaucggcuaccacgccaacaacucgaccgacaccguggacaccauccucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagucgcuguccaccgccagcuccuggucguacaucgucgagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggugaccgccgccugcccgcacgccggcgcgaaguccuucuacaagaaccugaucuggcucgucaagaaggggaacucguaccccaagcuguccaagagcuacaucaacgacaagggcaaggagauccuggugcucugggggauccaccaccccucgaccuccgccgaccagcagucgcuguaccagaacgccgacgccuacguguucgucggcacgucccgguacagcaagaaguucaagcccgagaucgccauccgcccgaaggugcgggaccaggagggccgcaugaacuacuacuggacccugguggagcccggggacaagaucaccuucgaggcgaccggcaaccucgucgugccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggucaacuccgugaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgucaagaaccucuacgagaaggugcgcucccagcugaagaacaacgccaaggagaucgggaacggcugcuucgaguucuaccacaagugcgacaacacgugcauggagggggugaagaacggcaccuacgacuaccccaaguacagcgaggaggccaagcugaaccgggaggagaucgacggggucaagcucgaguccacccgcaucuaccagauccuggcgaucuacucgaccguggccuccagccuggugcucgucgugucgcugggcgccaucuccuucuggaugugcagcaacggcucccugcagugccggaucugcaucuga

SEQ ID NO: 4702 - RNA, 1701 nt, Artificial Sequence; identical to SEQ ID NO: 4665
  derived and/or modified CDS sequence (AUadapt) from InfluenzaA__ADE20908__HA

SEQ ID NO: 4703 - RNA, 1701 nt, Artificial Sequence
  derived and/or modified CDS sequence (AUadapt) from InfluenzaA__ADE20918__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccucguccuggagcuacaucguggagaccuccucguccgacaacggcacgugcuaccccggcgacuucaucgacuacgaggagcugcgggagcagcucagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcuggugaagaaggggaacagcuaccccaagcucuccaagucguacaucaacgacaagggcaaggaggugcugguccugugggggauccaccaccccagcaccuccgccgaccagcagucgcucuaccagaacgccgacgccuacguguucgugggcacgucccgguacagcaagaaguucaagcccgagaucgccauccgcccgaagguccgggaccaggagggccgcaugaacuacuacuggauccugguggagcccggggacaagaucaccuucgaggcgaccggcaaccugguggucccccgguacgccuucgccauggagcgcaacgccggguccggcaucaucaucucggacacccccgugcacgacugcaacacgaccugccagaccccgaagggcgccaucaacaccucccuccccuuccagaacauccaccccaucacgaucgggaagugccccaaguacgucaagagcaccaagcugcggcuggcgaccggccuccgcaacgugccguccauccagucgcgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccuggacaucuggacguacaacgccgagcuccuggugcugcucgagaacgagcggacccuggacuaccacgacucgaacgugaagaaccuguacgagaagguccgcucccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcuggagucgacccgcaucuaccagauccucgcgaucuacuccaccgucgccagcucgcuggugcugguggucucccucggggccaucagcuucuggaugugcuccaacggcagccugcagugccggaucugcaucuga

SEQ ID NO: 4704 - RNA, 1701 nt, Artificial Sequence; identical to SEQ ID NO: 3267
  derived and/or modified CDS sequence (AUadapt) from InfluenzaA__ADE20928__HA

SEQ ID NO: 4705 - RNA, 1701 nt, Artificial Sequence
  derived and/or modified CDS sequence (AUadapt) from InfluenzaA__ADE20948__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucaacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacuccuacguguucgugggcacgagccgguacuccaagaaguucaagcccgagaucgccauccgcccgaagguccgggaccaggagggccgcaugaacuacuacuggacccugguggagcccggggacaagaucaccuucgaggccaccggcaaccucguggucccccgguacgcguucgccauggagcgcaacgccgggucgggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgccaccggccugcgcaacgucccgucgauccagucccgggggcuguucggcgcgaucgccggguucaucgagggcggcuggacggggaugguggacggcugguacggguaccaccaccagaacgagcagggcagcggguacgccgccgaccucaaguccacccagaacgccaucgacaagaucaccaacaaggugaacucggucaucgagaagaugaacacccaguucacggcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggccaucuacagcaccgucgcgucgucccuggugcucguggucagccugggggccaucuccuucuggaugugcagcaacggcucccugcagugccggaucugcaucuga

SEQ ID NO: 4706 - RNA, 1701 nt, Artificial Sequence
  derived and/or modified CDS sequence (AUadapt) from InfluenzaA__ADE20968__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgaggcgccccugcaccucgggaagugcaacaucgccggcuggauccuggggaacccggagugcgagucgcuguccaccgccagcuccuggucguacaucgucgagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacagcaacaagggggugaccgccgccugcccgcacuccggcgccaagucguucuacaagaaccugaucuggcucgucaagaaggggaacuccuaccccaagcugagcaagucguacaucaacgacaagggcaaggaggugcuggugcucugggggauccaccaccccuccaccagcgcggaccagcagucccuguaccagaacgccgacgccuacgucuucgugggcacgucgcgguacuccaagaaguucaagcccgagaucgccauccgcccgaaggugcgggaccaggagggccgcaugaacuacuacuggacccuggucgagcccggggacaagaucaccuucgaggccaccggcaaccucguggugccccgguacgcguucgccauggagcgcaacgccgggagcggcaucaucaucuccgacacgcccguccacgacugcaacacgaccugccagaccccgaagggcgccaucaacaccucgcugcccuuccagaacauccaccccaucaccaucgggaagugccccaaguacgugaaguccaccaagcugcggcucgccaccggccugcgcaacgugccgagcauccagucccgggggcuguucggcgcgaucgccggguucaucgagggcggcuggacggggauggucgacggcugguacggguaccaccaccagaacgagcagggcucgggguacgccgccgaccucaaguccacccagaacgccaucgacaagaucaccaacaaggugaacagcgugaucgagaagaugaacacccaguucacggcggucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcucgcagcugaagaacaacgccaaggagaucgggaacggcugcuucgaguucuaccacaagugcgacaacacgugcauggaguccgucaagaacgggaccuacgacuaccccaaguacagcgaggaggccaagcugaaccgggaggagaucgacggcgugaagcucgaguccacccgcaucuaccagauccuggccaucuacucgaccguggcgagcucccugguccucguggugucgcugggggccaucuccuucuggaugugcagcaacggcucccugcagugccggaucugcaucuga

SEQ ID NO: 4707 - RNA, 1701 nt, Artificial Sequence; identical to SEQ ID NO: 4078
  derived and/or modified CDS sequence (AUadapt) from InfluenzaA__ADE20978__HA

SEQ ID NO: 4708 - RNA, 1701 nt, Artificial Sequence
  derived and/or modified CDS sequence (AUadapt) from InfluenzaA__ADE20988__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccacggaccagcagagccuguaccagaacgccgacgccuacguguucgugggcaccucccgguacucgaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcggcucgccacgggccugcgcaacaucccguccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacgagaucaccaacaaggugaacuccgugaucgagaagaugaacacgcaguucaccgcggucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaagcgggaggagaucgacggcgugaagcucgagagcacccgcaucuaccagauccuggccaucuacuccaccguggcgucgagccugguccucguggugucccugggggccaucucguucuggaugugcuccaacggcagccugcagugccggaucugcaucuga

SEQ ID NO: 4709 - RNA, 1701 nt, Artificial Sequence; identical to SEQ ID NO: 4078
  derived and/or modified CDS sequence (AUadapt) from InfluenzaA__ADE20998__HA

SEQ ID NO: 4710 - RNA, 1701 nt, Artificial Sequence; identical to SEQ ID NO: 4242
  derived and/or modified CDS sequence (AUadapt) from InfluenzaA__ADE21008__HA

SEQ ID NO: 4711 - RNA, 1701 nt, Artificial Sequence
  derived and/or modified CDS sequence (AUadapt) from InfluenzaA__ADE21018__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccaccgccugcccgcacgccggcgccaaguccuucuacaagaaccugaucuggcucgugaagaaggggaacucguaccccaagcuguccaagagcuacaucaacgacaagggcaaggaggugcugguccucugggggauccaccaccccucgacguccaccgaccagcagagccuguaccagaacgcggacgccuacguguucgugggcaccucccgguacucgaagaaguucaagcccgagaucgccauccgcccgaagguccgggaccaggagggccgcaugaacuacuacuggacccugguggagcccggggacaagaucacguucgaggccaccggcaaccucguggucccccgguacgccuucgcgauggagcgcaacgccggguccggcaucaucaucagcgacacccccgugcacgacugcaacaccacgugccagaccccgaagggcgccaucaacaccucccugcccuuccagaacauccaccccaucaccaucgggaagugccccaaguacgucaagucgacgaagcugcggcucgccaccggccugcgcaacaucccguccauccagagccgggggcuguucggcgccaucgcgggguucaucgagggcggcuggaccgggaugguggacggcugguacggguaccaccaccagaacgagcagggcuccggguacgccgccgaccucaagucgacccagaacgccaucgacgagaucacgaacaaggugaacuccgugaucgagaagaugaacacccaguucaccgccgucggcaaggaguucaaccaccuggagaagcgcaucgagaaccugaacaagaagguggacgacggcuuccucgacaucuggaccuacaacgcggagcugcugguccuccuggagaacgagcggacgcuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggccaucuacuccaccguggccucgagccugguccucguggugucccugggggcgaucucguucuggaugugcuccaacggcagccugcagugccggaucugcaucuga

SEQ ID NO: 4712 - RNA, 1701 nt, Artificial Sequence; identical to SEQ ID NO: 4652
  derived and/or modified CDS sequence (AUadapt) from InfluenzaA__ADE21028__HA

SEQ ID NO: 4713 - RNA, 1701 nt, Artificial Sequence; identical to SEQ ID NO: 4642
  derived and/or modified CDS sequence (AUadapt) from InfluenzaA__ADE21038__HA

SEQ ID NO: 4714 - RNA, 1701 nt, Artificial Sequence; identical to SEQ ID NO: 4665
  derived and/or modified CDS sequence (AUadapt) from InfluenzaA__ADE21048__HA

SEQ ID NO: 4715 - RNA, 1701 nt, Artificial Sequence
  derived and/or modified CDS sequence (AUadapt) from InfluenzaA__ADE21058__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaucaacuacuacuggacccugguggagcccggggacaagaucaccuucgaggcgaccggcaaccucguggucccccgguacgccuucgccauggagcgcaacgccggguccggcaucaucaucucggacacgcccgcccacgacugcaacacgaccugccagaccccgaagggcgcgaucaacaccucccugcccuuccagaacauccaccccaucaccaucgggaagugccccaaguacgucaagagcaccaagcugcggcucgccaccggccugcgcaacgugccguccauccagucgcgggggcuguucggcgccaucgccggguucaucgagggcggcuggacggggaugguggacggcugguacggguaccaccaccagaacgagcagggcuccggguacgccgcggaccucaagucgacccagaacgccaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggcgaagcugaaccgggaggagaucgacggcgugaagcucgagagcacccgcaucuaccagauccuggccaucuacuccaccguggccucgagccugguccucguggugucccugggggccaucucguucuggaugugcuccaacggcagccugcagugccggaucugcaucuga

SEQ ID NO: 4716 - RNA, 1701 nt, Artificial Sequence
  derived and/or modified CDS sequence (AUadapt) from InfluenzaA__ADE21068__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccacucgaucaccaucgggaagugccccaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcucgggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaccgggaacggcugcuucgaguucuaccacaagugcgacaacacgugcauggaguccgugaagaacgggaccuacgacuacccgaaguacagcgaggaggccaagcugaaccgggaggagaucgacggcgugaagcucgaguccacccgcaucuaccagauccuggcgaucuacucgaccgucgccagcucccuggugcucguggucucgcugggggccaucuccuucuggaugugcagcaacggcucccugcagugccggaucugcaucuga

SEQ ID NO: 4717 - RNA, 1698 nt, Artificial Sequence
  derived and/or modified CDS sequence (AUadapt) from InfluenzaA__ADE28761__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccucgugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcaaccagaagacccuguaccacacggagaacgccuacgugucggucgugagcucccacuacagccggaaguucacccccgagaucgccaagcgccccaaggugcgggaccaggagggccgcaucaacuacuacuggacccuccuggagcccggggacaccaucaucuucgaggccaacggcaaccugaucgcgccgcgguacgccuucgcccucucccgcggguucggcagcggcaucaucaacuccaacgcccccauggacaagugcgacgccaagugccagacgccccagggggcgaucaacucgucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgccgcggaccagaaguccacgcagaacgccaucaacggcaucaccaacaaggugaacucggucaucgagaagaugaacacccaguucaccgccguggggaaggaguucaacaagcuggagcggcgcauggagaaccucaacaagaaggucgacgacggcuucaucgacaucuggacguacaacgccgagcugcuggugcuccuggagaacgagcggacccuggacuuccacgagagcaacgugaagaaccucuacgagaaggucaagucccagcugaagaacaacgccaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgugaagcucgaguccauggaggucuaccagauccuggcgaucuacucgaccguggccagcucccuggugcuccuggucagccugggcgccaucuccuucuggaugugcagcaacgggucccuccagugccggaucugcaucuga

SEQ ID NO: 4718 - RNA, 1701 nt, Artificial Sequence; identical to SEQ ID NO: 96
  derived and/or modified CDS sequence (AUadapt) from InfluenzaA__ADE28780__HA

SEQ ID NO: 4719 - RNA, 1701 nt, Artificial Sequence; identical to SEQ ID NO: 4502
  derived and/or modified CDS sequence (AUadapt) from InfluenzaA__ADE28790__HA

SEQ ID NO: 4720 - RNA, 1701 nt, Artificial Sequence; identical to SEQ ID NO: 4686
  derived and/or modified CDS sequence (AUadapt) from InfluenzaA__ADE28800__HA

SEQ ID NO: 4721 - RNA, 1701 nt, Artificial Sequence; identical to SEQ ID NO: 4078
  derived and/or modified CDS sequence (AUadapt) from InfluenzaA__ADE28810__HA

SEQ ID NO: 4722 - RNA, 1701 nt, Artificial Sequence
  derived and/or modified CDS sequence (AUadapt) from InfluenzaA__ADE28820__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggagcccggagugcgagucccugucgaccgcguccagcugguccuacaucguggagaccucguccagcgacaacggcacgugcuaccccggcgacuucaucgacuacgaggagcuccgggagcagcuguccucgguguccagcuucgagcgcuucgagaucuuccccaagaccuccucguggcccaaccacgacuccaacaagggggucaccgccgccugcccgcacgccggcgccaagagcuucuacaagaaccugaucuggcucgugaagaaggggaacuccuaccccaagcugucgaagagcuacaucaacgacaagggcaaggaggugcugguccucugggggauccaccaccccuccaccucggccgaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggucgggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgcgaccggccugcgcaacgucccgucgauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacaagaucaccaacaaggugaacucggucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 4723 - RNA, 1701 nt, Artificial Sequence; identical to SEQ ID NO: 96
  derived and/or modified CDS sequence (AUadapt) from InfluenzaA__ADE28830__HA

SEQ ID NO: 4724 - RNA, 1701 nt, Artificial Sequence; identical to SEQ ID NO: 96
  derived and/or modified CDS sequence (AUadapt) from InfluenzaA__ADE28840__HA

SEQ ID NO: 4725 - RNA, 1701 nt, Artificial Sequence; identical to SEQ ID NO: 96
  derived and/or modified CDS sequence (AUadapt) from InfluenzaA__ADE28850__HA

SEQ ID NO: 4726 - RNA, 1701 nt, Artificial Sequence; identical to SEQ ID NO: 96
  derived and/or modified CDS sequence (AUadapt) from InfluenzaA__ADE28881__HA

SEQ ID NO: 4727 - RNA, 1701 nt, Artificial Sequence; identical to SEQ ID NO: 96
  derived and/or modified CDS sequence (AUadapt) from InfluenzaA__ADE28891__HA

SEQ ID NO: 4728 - RNA, 1701 nt, Artificial Sequence; identical to SEQ ID NO: 4597
  derived and/or modified CDS sequence (AUadapt) from InfluenzaA__ADE28911__HA

SEQ ID NO: 4729 - RNA, 1701 nt, Artificial Sequence; identical to SEQ ID NO: 4078
  derived and/or modified CDS sequence (AUadapt) from InfluenzaA__ADE28921__HA

SEQ ID NO: 4730 - RNA, 1701 nt, Artificial Sequence; identical to SEQ ID NO: 4078
  derived and/or modified CDS sequence (AUadapt) from InfluenzaA__ADE28931__HA

SEQ ID NO: 4731 - RNA, 1701 nt, Artificial Sequence; identical to SEQ ID NO: 3267
  derived and/or modified CDS sequence (AUadapt) from InfluenzaA__ADE28951__HA

SEQ ID NO: 4732 - RNA, 1701 nt, Artificial Sequence
  derived and/or modified CDS sequence (AUadapt) from InfluenzaA__ADE28961__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacguggccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgucagcuccuucgagcgcuucgagaucuuccccaagaccucguccuggcccaaccacgacagcaacaagggggugaccgccgccugcccgcacgccggcgcgaaguccuucuacaagaaccugaucuggcucgugaagaaggggaacucguaccccaagcuguccaagagcuacaucaacgacaagggcaaggagguccuggugcucugggggauccaccaccccucgaccuccgccgaccagcagagccuguaccagaacgccgacgccuacguguucgucggcacgucccgguacucgaagaaguucaagcccgagaucgccauccgcccgaaggugcgggaccaggagggccgcaugaacuacuacuggacccugguggagcccggggacaagaucaccuucgaggcgaccggcaaccucgucgugccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggucaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgucaagcucgagagcacccgcaucuaccagauccuggcgaucuacuccaccguggccucgagccuggugcucgucgugucccugggggccaucucguucuggaugugcuccaacggcagccugcagugccggaucugcaucuga

SEQ ID NO: 4733 - RNA, 1701 nt, Artificial Sequence; identical to SEQ ID NO: 4618
  derived and/or modified CDS sequence (AUadapt) from InfluenzaA__ADE28971__HA

SEQ ID NO: 4734 - RNA, 1701 nt, Artificial Sequence
  derived and/or modified CDS sequence (AUadapt) from InfluenzaA__ADE28981__HA
augaaggccauccuggugguccuccuguacaccuucgccaccgcgaacgccgacacgcugugcaucggcuaccacgccaacaacucgaccgagaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 4735 - RNA, 1701 nt, Artificial Sequence; identical to SEQ ID NO: 4078
  derived and/or modified CDS sequence (AUadapt) from InfluenzaA__ADE28991__HA

SEQ ID NO: 4736 - RNA, 1701 nt, Artificial Sequence
  derived and/or modified CDS sequence (AUadapt) from InfluenzaA__ADE29001__HA
augaaggccauccuggugguccuccuguacaccuucgccaccgcgaacgccgacacgcugugcaucggcuaccacgccaacaacucgaccgacaccguggacaccgugcucgagcgcaacgucacggugacccacuccgugaaccugcuggaggacaagcacaacgggaagcucugcaagcugaagggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 4737 - RNA, 1701 nt, Artificial Sequence; identical to SEQ ID NO: 3156
  derived and/or modified CDS sequence (AUadapt) from InfluenzaA__ADE29011__HA

SEQ ID NO: 4738 - RNA, 1701 nt, Artificial Sequence
  derived and/or modified CDS sequence (AUadapt) from InfluenzaA__ADE29021__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccggcagcgacaacggcacgugcuaccccggggacuucaucgacuacgaggagcuccgggagcagcuguccucgguguccucguucgagcgcuucgagaucuuccccaagaccuccagcuggcccaaccacgacuccaacaagggcgucaccgccgccugcccgcacgccggggccaagucguucuacaagaaccugaucuggcucgugaagaagggcaacuccuaccccaagcugagcaaguccuacaucaacgacaaggggaaggaggugcugguccucuggggcauccaccaccccucgaccucgacggaccagcagucccuguaccagaacgccgacgccuacgugagcgugggcaccucccgguacucgaagaaguucaagcccgagaucgccauccgcccgaagguccgggaccaggaggggcgcaugaacuacuacuggacccugguggagcccggcgacaagaucaccuucgaggccacggggaaccucguggucccccgguacgcguucgccauggagcgcaacgccggcuccggcaucaucaucagcgacacccccgugcacgacugcaacacgaccugccagaccccgaagggggccaucaacaccucccugcccuuccagaacauccaccccaucaccaucggcaagugccccaaguacgucaagucgaccaagcugcggcucgccacggggcugcgcaacgugccguccauccagucgcggggccuguucggggcgaucgccggcuucaucgagggcggguggaccggcaugguggacgggugguacggcuaccaccaccagaacgagcagggguccggcuacgccgccgaccucaagagcacccagaacgccaucgacaagaucaccaacaaggugaacuccgucaucgagaagaugaacacgcaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacucgaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagucgacccgcaucuaccagauccuggccaucuacuccaccgucgcgucgagccuggugcucguggucucccugggcgccaucucguucuggaugugcuccaacggcagccugcagugccggaucugcaucuga

SEQ ID NO: 4739 - RNA, 1701 nt, Artificial Sequence; identical to SEQ ID NO: 4563
  derived and/or modified CDS sequence (AUadapt) from InfluenzaA__ADE29031__HA

SEQ ID NO: 4740 - RNA, 1701 nt, Artificial Sequence
  derived and/or modified CDS sequence (AUadapt) from InfluenzaA__ADE29041__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagaagaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggcgaucuacuccaccgucgccucgagccuggugcucguggucucccugggggccaucucguucuggaugugcuccaacggcagccugcagugccgcaucugcaucuga

SEQ ID NO: 4741 - RNA, 1701 nt, Artificial Sequence; identical to SEQ ID NO: 4563
  derived and/or modified CDS sequence (AUadapt) from InfluenzaA__ADE29051__HA

SEQ ID NO: 4742 - RNA, 1701 nt, Artificial Sequence
  derived and/or modified CDS sequence (AUadapt) from InfluenzaA__ADE29085__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagacccccuccagcgacaacggcacgugcuaccccggcgacuucaucgacuacgaggagcuccgggagcagcuguccucgguguccagcuucgagcgcuucgagaucuuccccaagaccuccucguggccgaaccacgacuccaacaagggggucaccgccgccugcccccacgccgaggccaagagcuucuacaagaaccugaucuggcucgugaagaagggcaacuccuaccccaagcugucgaaguccuacaucaacgacaaggggaaggaggugcugguccucuggggcauccaccaccccagcaccucggccgaccagcagucccuguaccagaacgccgacgccuacguguucguggggagcucccgguacucgaagacguucaagccggagaucgccauccgccccaagguccgggaccgcgagggccggaugaacuacuacuggacccugguggagcccggcgacaagaucaccuucgaggcgaccgggaaccucguggucccccgcuacgccuucgccauggagcggaacgccggcuccgggaucaucaucagcgacacgccggugcacgacugcaacacgaccugccagacccccaagggcgccaucaacaccucccugcccuuccagaacauccaccccaucaccaucggcaagugcccgaaguacgucaagucgaccaagcugcgccucgcgaccgggcugcggaacauccccuccauccagagccgcggccuguucggggccaucgccggcuucaucgagggcggguggacgggcaugguggacgggugguacggcuaccaccaccagaacgagcagggguccggcuacgccgccgaccucaagucgacccagaacgcgaucgacgagaucaccaacaaggugaacuccgugaucgagaagaugaacacccaguucacggccgucgggaaggaguucaaccaccuggagaagcggaucgagaaccugaacaagaagguggacgacggcuuccucgacaucuggaccuacaacgccgagcugcugguccuccuggagaacgagcgcacccuggacuaccacgacagcaacgugaagaaccucuacgagaaggugcggucccagcugaagaacaacgccaaggagaucggcaacgggugcuucgaguucuaccacaagugcgacaacacgugcauggagucggucaagaacggcaccuacgacuaccccaaguacuccgaggaggccaagcugaaccgcgaggagaucgacggggugaagcucgagagcacccggaucuaccagauccuggcgaucuacuccaccguggccucgagccugguccucguggugucccugggcgccaucucguucuggaugugcuccaacgggagccugcagugccgcaucugcaucuga

SEQ ID NO: 4743 - RNA, 1701 nt, Artificial Sequence; identical to SEQ ID NO: 58
  derived and/or modified CDS sequence (AUadapt) from InfluenzaA__ADE29095__HA

SEQ ID NO: 4744 - RNA, 1701 nt, Artificial Sequence; identical to SEQ ID NO: 3833
  derived and/or modified CDS sequence (AUadapt) from InfluenzaA__ADE34191__HA

SEQ ID NO: 4745 - RNA, 1701 nt, Artificial Sequence; identical to SEQ ID NO: 3833
  derived and/or modified CDS sequence (AUadapt) from InfluenzaA__ADE34202__HA

SEQ ID NO: 4746 - RNA, 1701 nt, Artificial Sequence
  derived and/or modified CDS sequence (AUadapt) from InfluenzaA__ADE34213__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgccggaaggccuacagcaacugcuaccccuacgacgugccggacuacgcgucccugcgcucgcucgucgccuccucgggcacgcuggaguucaacaacgaguccuucaacuggaccggggugacccagaacggcaccagcuccgccugcauccggcgcucgaacaacuccuucuucagccggcugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccuccgggcgcaucaccgugucgacgaagcggucccagcagaccgugaucccgaacaucggcucgcgcccccggguccgcaacauccccagccggaucuccaucuacuggaccaucgugaagcccggcgacauccugcucaucaacucgaccgggaaccugaucgccccgcgcggcuacuucaagauccgguccgggaaguccuccaucaugcgcagcgacgcccccaucggcaagugcaacuccgagugcaucacgcccaacggcucgauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggguucaucgagaacggcugggagggcaugguggacgggugguacggcuuccggcaccagaacuccgaggggcgcggccaggccgccgaccucaagucgacccaggcggccaucgaccagaucaacgggaagcugaaccggcugaucggcaagaccaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgcgugcaucgggucgauccggaacggcaccuacgaccacgacgucuaccgcgacgaggcccucaacaaccgguuccagaucaaggggguggagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 4747 - RNA, 1701 nt, Artificial Sequence; identical to SEQ ID NO: 3833
  derived and/or modified CDS sequence (AUadapt) from InfluenzaA__ADE34224__HA

SEQ ID NO: 4748 - RNA, 1701 nt, Artificial Sequence
  derived and/or modified CDS sequence (AUadapt) from InfluenzaA__ADE34235__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcaagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagucguucaacuggaccggggugacccaggacggcaccuccagcgccugcauccgccgguccaagaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccucggggcggaccacgguguccaccaagcgcagccagcagaccgccaucccgaacaucggcucgcggccccgcgugcggaacauccccucccgcaucucgaucuacuggaccaucgucaagcccggcgacauccugcucaucaacuccacggggaaccugaucgccccgcggggcuacuucaagauccgcagcgggaaguccucgaucaugcgguccgacgcccccaucggcaagugcaacucggagugcaucacccccaacggcuccauccccaacgacaagccguuccagaacgugaaccgcaucaccuacggggcgugcccccgguacgugaagcagaacacccugaagcucgccacgggcaugcgcaacguccccgagaagcagacccgggggaucuucggcgccaucgccggguucaucgagaacggcugggagggcaugguggacgggugguacggcuuccgccaccagaacagcgaggggcggggccaggccgcggaccugaaguccacccaggccgccaucgaccagaucaacgggaagcugaaccgccucaucggcaagaccaacgagaaguuccaccagaucgagaaggaguucucggagguggagggccggauccaggaccuggagaaguacgucgaggacacgaagaucgaccugugguccuacaacgccgagcuccugguggcccuggagaaccagcacaccaucgaccucaccgacucggagaugaacaagcuguucgagaagaccaagaagcagcugcgcgagaacgcggaggacauggggaacggcugcuucaagaucuaccacaagugcgacaacgccugcaucggguccauccgcaacggcacguacgaccacgacguguaccgggacgaggcccucaacaaccgcuuccagaucaagggggucgagcugaaguccggcuacaaggacuggauccuguggaucuccuucgccaucagcugcuuccuccugugcguggcccugcucggcuucaucaugugggcgugccagaaggggaacauccggugcaacaucugcaucuga

SEQ ID NO: 4749 - RNA, 1701 nt, Artificial Sequence; identical to SEQ ID NO: 3833
  derived and/or modified CDS sequence (AUadapt) from InfluenzaA__ADE34246__HA

SEQ ID NO: 4750 - RNA, 1701 nt, Artificial Sequence; identical to SEQ ID NO: 3858
  derived and/or modified CDS sequence (AUadapt) from InfluenzaA__ADE34257__HA

SEQ ID NO: 4751 - RNA, 1701 nt, Artificial Sequence
  derived and/or modified CDS sequence (AUadapt) from InfluenzaA__ADE34268__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcaagaacugcacccugaucgacgcccugcucggggacccccagugcgacggcuuccagaacaagaagugggaccuguucguggagcgcucgaaggccuacuccaacugcuaccccuacgaggugccggacuacgcgagccugcggucccucgucgccucguccggcacgcuggaguucaacaacgagagcuucaacuggaccggggugacccaggacggcaccuccucggccugcauccgccgguccaagaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcagaccgccaucccgaacaucggcucgcggccccgcgugcggaacauccccucccgcaucagcaucuacuggaccaucgucaagcccggcgacauccugcucaucaacuccaccgggaaccugaucgccccgcggggcuacuucaagauccgcucggggaaguccagcaucaugcgguccgacgcccccaucggcaagugcaacucggagugcaucacgcccaacggcuccauccccaacgacaagccguuccagaacgugaaccgcaucaccuacggggcgugcccccgguacgugaagcagaacacccugaagcucgccaccggcaugcgcaacguccccgagaagcagacgcgggggaucuucggcgccaucgccggguucaucgagaacggcugggagggcaugguggacgggugguacggcuuccgccaccagaacucggaggggcggggccaggccgcggaccugaaguccacccaggccgccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacacgaucgaccucaccgacucggagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacguguaccgggacgaggcccucaacaaccgcuuccagaucaagggggucgagcugaaguccggcuacaaggacuggauccuguggaucuccuucgccaucagcugcuuccuccugugcguggcccugcucggcuucaucaugugggcgugccagaaggggaacauccggugcaacaucugcaucuga

SEQ ID NO: 4752 - RNA, 1701 nt, Artificial Sequence
  derived and/or modified CDS sequence (AUadapt) from InfluenzaA__ADE45499__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccagcuccgacaacggcacgugcuaccccggcgacuucaucgacuacgaggagcuccgggagcagcugucguccgugagcuccuucaagcgcuucgagaucuuccccaagaccucguccuggcccaaccacgacccgaacaagggggucaccgccgccugcccccacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacguguucgugggcacgucgcgguacuccaagaaguucaagccggagaucgccauccgccccaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgccggugcacgacugcaacacgaccugccagacccccaagggcgccaucaacaccucgcugcccuuccagaacauccaccccaucaccaucgggaagugcccgaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcucgggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 4753 - RNA, 1701 nt, Artificial Sequence; identical to SEQ ID NO: 3712
  derived and/or modified CDS sequence (AUadapt) from InfluenzaA__ADE45501__HA

SEQ ID NO: 4754 - RNA, 1701 nt, Artificial Sequence
  derived and/or modified CDS sequence (AUadapt) from InfluenzaA__ADE45503__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacccgaacaagggggucaccgccgccugcccccacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacguguucgugggcacgucgcgguacuccaagaaguucaagccggagaucgccauccgccccaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgccggugcacgacugcaacacgaccugccagacccccaagggcgccaucaacaccucgcugcccuuccagaacauccaccccaucaccaucgggaagugcccgaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcucgggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcgucuaccagauccuggcgaucuacucgaccguggccuccagccuggugcucgucgugucgcugggggccaucuccuucuggaugugcagcaacggcucccugcagugccggaucugcaucuga

SEQ ID NO: 4755 - RNA, 1701 nt, Artificial Sequence; identical to SEQ ID NO: 116
  derived and/or modified CDS sequence (AUadapt) from InfluenzaA__ADE45505__HA

SEQ ID NO: 4756 - RNA, 1701 nt, Artificial Sequence; identical to SEQ ID NO: 3267
  derived and/or modified CDS sequence (AUadapt) from InfluenzaA__ADE45507__HA

SEQ ID NO: 4757 - RNA, 1701 nt, Artificial Sequence; identical to SEQ ID NO: 3267
  derived and/or modified CDS sequence (AUadapt) from InfluenzaA__ADE45509__HA

SEQ ID NO: 4758 - RNA, 1701 nt, Artificial Sequence; identical to SEQ ID NO: 3712
  derived and/or modified CDS sequence (AUadapt) from InfluenzaA__ADE45511__HA

SEQ ID NO: 4759 - RNA, 1701 nt, Artificial Sequence
  derived and/or modified CDS sequence (AUadapt) from InfluenzaA__ADE45513__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccagcuccgacaacggcacgugcuaccccggcgacuucaucgacuacgaggagcuccgggagcagcugucguccgugucguccuucgagcgcuucgagaucuuccccaagaccagcuccuggcccaaccacgacccgaacaagggggucaccgccgccugcccccacgccggcgccaagucguucuacaagaaccugaucuggcucgugaagaaggggaacuccuaccccaagcugagcaaguccuacaucaacgacaagggcaaggaggugcugguccucugggggauccaccaccccucgaccagcgccgaccagcagucccuguaccagaacgccgacgccuacgccuucgugggcacgucgcgguacuccaagaaguucaagccggagaucgcgauccgccccaaggugcgggaccaggagggccgcaucaacuacuacuggacccuggucgagcccggggacaagaucaucuucgaggccaccggcaaccucguggugccccgguacgccuucgccauggagcgcaacgccgggucgggcaucaucaucuccgacaccccggcgcacgacugcaacacgaccugccagacccccaagggcgccaucaacaccagccugcccuuccagaacauccaccccaucacgaucgggaagugcccgaaguacgucaaguccaccaagcugcggcucgccaccggccugcgcaacgugcccucgauccagucccgggggcuguucggcgccaucgccggguucaucgagggcggcuggaccgggaugguggacggcugguacggguaccaccaccagaacgagcagggcagcggguacgcggccgaccucaaguccacgcagaacgccaucgacgagaucaccaacaaggucaacucggugaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgucaagaaccucuacgagaaggugcgcucgcagcugaagaacaacgcgaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgucaagcucgaguccacccgcaucuaccagauccuggccaucuacucgaccguggccuccagccuggugcucgucgugucgcugggggcgaucuccuucuggaugugcagcaacggcucccugcagugccggaucugcaucuga

SEQ ID NO: 4760 - RNA, 1701 nt, Artificial Sequence
  derived and/or modified CDS sequence (AUadapt) from InfluenzaA__ADE75388__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgagaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 4761 - RNA, 1701 nt, Artificial Sequence; identical to SEQ ID NO: 116
  derived and/or modified CDS sequence (AUadapt) from InfluenzaA__ADE75390__HA

SEQ ID NO: 4762 - RNA, 1701 nt, Artificial Sequence; identical to SEQ ID NO: 116
  derived and/or modified CDS sequence (AUadapt) from InfluenzaA__ADF10067__HA

SEQ ID NO: 4763 - RNA, 1701 nt, Artificial Sequence; identical to SEQ ID NO: 116
  derived and/or modified CDS sequence (AUadapt) from InfluenzaA__ADF10077__HA

SEQ ID NO: 4764 - RNA, 1701 nt, Artificial Sequence
  derived and/or modified CDS sequence (AUadapt) from InfluenzaA__ADF10087__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccaugaagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 4765 - RNA, 1701 nt, Artificial Sequence
  derived and/or modified CDS sequence (AUadapt) from InfluenzaA__ADF10097__HA
auggaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagcaaguacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggucgggcaucaucaucuccgacacccccgugcacgacugcaacacgaccugccagaccccgaagggcgccaucaacaccagccugcccuuccacaacauccaccccaucacgaucgggaagugccccaaguacgugaaguccaccaagcugcgccucgcgaccggccugcggaacgucccgucgauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgcgaggagaucgacggcgugaagcucgaguccaccaagaucuaccagauccuggcgaucuacagcaccgucgccucgucccuggugcucguggucagccugggggccaucuccuucuggaugugcagcaacggcucccugcagugccggaucugcaucuga

SEQ ID NO: 4766 - RNA, 1701 nt, Artificial Sequence
  derived and/or modified CDS sequence (AUadapt) from InfluenzaA__ADF10107__HA
auggaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccacccgcccaccagcgccgaccagcagucccuguaccagaacgccgacgccuacguguucgugggcucguccaaguacagcaagaaguucaagcccgagaucgccauccggcccaagguccgcgaccaggagggccggaugaacuacuacuggacgcugguggagcccggggacaagaucaccuucgaggcgaccggcaaccucguggucccccgcuacgccuucgccauggagcggaacgccggguccggcaucaucaucucggacaccccggcccacgacugcaacacgaccugccagacccccaagggcgcgaucaacaccucccugcccuuccacaacauccaccccaucacgaucgggaagugcccgaaguacgucaagagcaccaagcugcgccucgccaccggccugcggaacgugcccuccauccagucgcgcgggcuguucggcgccaucgccggguucaucgagggcggcuggaccgggaugguggacggcugguacggguaccaccaccagaacgagcagggcuccggguacgccgcggaccucaagucgacgcagaacgccaucgacgagaucaccaacaaggugaacuccgugaucgagaagaugaacacccaguucaccgccgucggcaaggaguucaaccaccuggagaagcggaucgagaaccugaacaagaagguggacgacggcuuccucgacaucuggacguacaacgccgagcugcugguccuccuggagaacgagcgcacccuggacuaccacgacagcaacgugaagaaccucuacgagaaggugcggucccagcugaagaacaacgccaaggagaucgggaacggcugcuucgaguucuaccacaagugcgacaacacgugcauggagucggucaagaacgggaccuacgacuaccccaaguacuccgaggaggcgaagcugaaccgcgaggagaucgacggcgugaagcucgagagcaccaagaucuaccagauccuggccaucuacuccaccguggccucgagccugguccucguggugucccugggggccaucucguucuggaugugcuccaacggcagccugcagugccggaucugcaucuga

SEQ ID NO: 4767 - RNA, 1701 nt, Artificial Sequence; identical to SEQ ID NO: 116
  derived and/or modified CDS sequence (AUadapt) from InfluenzaA__ADF10117__HA

SEQ ID NO: 4768 - RNA, 1701 nt, Artificial Sequence; identical to SEQ ID NO: 4618
  derived and/or modified CDS sequence (AUadapt) from InfluenzaA__ADF10127__HA

SEQ ID NO: 4769 - RNA, 1701 nt, Artificial Sequence; identical to SEQ ID NO: 116
  derived and/or modified CDS sequence (AUadapt) from InfluenzaA__ADF10137__HA

SEQ ID NO: 4770 - RNA, 1701 nt, Artificial Sequence
  derived and/or modified CDS sequence (AUadapt) from InfluenzaA__ADF10154__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccgaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagcgcguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggcgaucuacuccaccgucgccucgagccuggugcucguggucucccugggggccaucucguucuggaugugcuccaacggcagccugcagugccgcaucugcaucuga

SEQ ID NO: 4771 - RNA, 1701 nt, Artificial Sequence
  derived and/or modified CDS sequence (AUadapt) from InfluenzaA__ADF10174__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagcgcguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggcgaucuacuccaccgucgccucgagccuggugcucguggucucccugggggccaucucguucuggaugugcuccaacggcagccugcagugccgcaucugcaucuga

SEQ ID NO: 4772 - RNA, 1701 nt, Artificial Sequence; identical to SEQ ID NO: 4771
  derived and/or modified CDS sequence (AUadapt) from InfluenzaA__ADF10190__HA

SEQ ID NO: 4773 - RNA, 1701 nt, Artificial Sequence; identical to SEQ ID NO: 4618
  derived and/or modified CDS sequence (AUadapt) from InfluenzaA__ADF10237__HA

SEQ ID NO: 4774 - RNA, 1701 nt, Artificial Sequence; identical to SEQ ID NO: 4771
  derived and/or modified CDS sequence (AUadapt) from InfluenzaA__ADF10262__HA

SEQ ID NO: 4775 - RNA, 1701 nt, Artificial Sequence
  derived and/or modified CDS sequence (AUadapt) from InfluenzaA__ADF10288__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagcgcguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggcgaucuacuccaccgucgccucgagccuggugcucguggucucccugggggccaucucguucuggaugugcuccaacggcagccugcagugccgcgugugcaucuga

SEQ ID NO: 4776 - RNA, 1701 nt, Artificial Sequence; identical to SEQ ID NO: 4618
  derived and/or modified CDS sequence (AUadapt) from InfluenzaA__ADF10302__HA

SEQ ID NO: 4777 - RNA, 1701 nt, Artificial Sequence; identical to SEQ ID NO: 4618
  derived and/or modified CDS sequence (AUadapt) from InfluenzaA__ADF10335__HA

SEQ ID NO: 4778 - RNA, 1701 nt, Artificial Sequence; identical to SEQ ID NO: 4618
  derived and/or modified CDS sequence (AUadapt) from InfluenzaA__ADF10359__HA

SEQ ID NO: 4779 - RNA, 1701 nt, Artificial Sequence; identical to SEQ ID NO: 4771
  derived and/or modified CDS sequence (AUadapt) from InfluenzaA__ADF10369__HA

SEQ ID NO: 4780 - RNA, 1701 nt, Artificial Sequence; identical to SEQ ID NO: 4771
  derived and/or modified CDS sequence (AUadapt) from InfluenzaA__ADF10390__HA

SEQ ID NO: 4781 - RNA, 1701 nt, Artificial Sequence; identical to SEQ ID NO: 4618
  derived and/or modified CDS sequence (AUadapt) from InfluenzaA__ADF10528__HA

SEQ ID NO: 4782 - RNA, 1701 nt, Artificial Sequence; identical to SEQ ID NO: 4771
  derived and/or modified CDS sequence (AUadapt) from InfluenzaA__ADF10598__HA

SEQ ID NO: 4783 - RNA, 1701 nt, Artificial Sequence; identical to SEQ ID NO: 4771
  derived and/or modified CDS sequence (AUadapt) from InfluenzaA__ADF10670__HA

SEQ ID NO: 4784 - RNA, 1701 nt, Artificial Sequence; identical to SEQ ID NO: 4771
  derived and/or modified CDS sequence (AUadapt) from InfluenzaA__ADF10724__HA

SEQ ID NO: 4785 - RNA, 1701 nt, Artificial Sequence; identical to SEQ ID NO: 4618
  derived and/or modified CDS sequence (AUadapt) from InfluenzaA__ADF10757__HA

SEQ ID NO: 4786 - RNA, 1701 nt, Artificial Sequence
  derived and/or modified CDS sequence (AUadapt) from InfluenzaA__ADF10828__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccacggaccagcagagccuguaccagaacgccgacgccuacguguucgugggcaccucccgguacucgaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacaagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggccaucuacuccaccgucgcgucgagccuggugcucguggucucccugggggccaucucguucuggaugugcuccaacggcagccugcagugccggaucugcaucuga

SEQ ID NO: 4787 - RNA, 1701 nt, Artificial Sequence; identical to SEQ ID NO: 116
  derived and/or modified CDS sequence (AUadapt) from InfluenzaA__ADF10874__HA

SEQ ID NO: 4788 - RNA, 1701 nt, Artificial Sequence; identical to SEQ ID NO: 3537
  derived and/or modified CDS sequence (AUadapt) from InfluenzaA__ADF10929__HA

SEQ ID NO: 4789 - RNA, 1701 nt, Artificial Sequence; identical to SEQ ID NO: 3537
  derived and/or modified CDS sequence (AUadapt) from InfluenzaA__ADF10996__HA

SEQ ID NO: 4790 - RNA, 1701 nt, Artificial Sequence; identical to SEQ ID NO: 116
  derived and/or modified CDS sequence (AUadapt) from InfluenzaA__ADF27367__HA

SEQ ID NO: 4791 - RNA, 1701 nt, Artificial Sequence; identical to SEQ ID NO: 116
  derived and/or modified CDS sequence (AUadapt) from InfluenzaA__ADF27369__HA

SEQ ID NO: 4792 - RNA, 1701 nt, Artificial Sequence
  derived and/or modified CDS sequence (AUadapt) from InfluenzaA__ADF27370__HA
augaaggccauccuggugauccuccuguacaccuucgccaccgcgaacgccgacacgcugugcaucggcuaccacgccaacaacucgaccgacaccgucgacaccgugcucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagucgcuguccaccgccagcuccuggucguacaucgucgagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggugaccgccgccugcccgcacgccggcgcgaaguccuucuacaagaaccugaucuggcucgucaagaaggggaacagcuaccccaagcuguccaagucguacaucaacgacaagggcaaggaggugcuggugcucugggggauccaccaccccagcaccuccgccgaccagcagucgcuguaccagaacgccgacgccuacguccuggugggcacgucccgguacagcaagaaguucaagcccgagaucgccauccgcccgaaggugcgggaccaggagggccgcaugaacuacuacuggacccucgucgagcccggggacaagaucaccuucgaggcgaccggcaaccugguggugccccgguacgccuucgccauggagcgcaacgccggguccggcaucaucaucucggacacgcccguccacgacugcaacacgaccugccagaccccgaagggcgccaucaacaccucccugcccuuccagaacauccaccccaucaccaucgggaagugccccaaguacgucaagagcaccaagcuccggcuggcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgugaucgagaagaugaacacccaguucacggccgucggcaaggaguucaaccaccuggagaagcgcaucgagaaccucaacaagaagguggacgacggcuuccuggacaucuggaccuacaacgccgagcugcucguccugcuggagaacgagcggacccucgacuaccacgacagcaacgugaagaaccuguacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcucaaccgggaggagaucgacggcgugaagcuggagagcacccgcaucuaccagauccuggcgaucuacuccaccguggccucgagccucguccugguggugucccugggggccaucucguucuggaugugcuccaacggcagccuccagugccggaucugcaucuga

SEQ ID NO: 4793 - RNA, 1701 nt, Artificial Sequence; identical to SEQ ID NO: 4086
  derived and/or modified CDS sequence (AUadapt) from InfluenzaA__ADF27371__HA

SEQ ID NO: 4794 - RNA, 1701 nt, Artificial Sequence
  derived and/or modified CDS sequence (AUadapt) from InfluenzaA__ADF27372__HA
augaaggccauccuggugguccuccuguacaccuucgccaccgcgaacgccgacacgcugugcaucggcuaccacaccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagacguccagcuccgacaacgggaccugcuaccccggcgacuucaucgacuacgaggagcuccgggagcagcugucguccgugagcuccuucgagcgcuucgagaucuuccccaagaccucguccuggcccaaccacgacagcaacaagggcgucaccgccgccugcccgcacgccggcgccaaguccuucuacaagaaccugaucuggcucgugaagaaggggaacucguaccccaagcuguccaagagcuacaucaacgacaagggcaaggaggugcugguccucugggggauccaccaccccucgacguccgcggaccagcagagccuguaccagaacgccgacgccuacguguucgugggcaccucccgguacucgaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacaagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggccaucuacuccaccgucgcgucgagccuggugcucguggucucccugggggccaucucguucuggaugugcuccaacggcagccugcagugccggaucugcaucuga

SEQ ID NO: 4795 - RNA, 1701 nt, Artificial Sequence
  derived and/or modified CDS sequence (AUadapt) from InfluenzaA__ADF27373__HA
auggaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcucaucgagcagcugagcuccgugucguccuucgagcgguucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggucgggcaucaucaucuccgacacccccgugcacgacugcaacacgaccugccagaccccgaagggcgccaucaacaccagccugcccuuccacaacauccaccccaucacgaucgggaagugccccaaguacgugaaguccaccaagcugcgccucgcgaccggccugcggaacgucccgucgauccagacccgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacucgaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagucgacccggaucuaccagauccuggcgaucuacuccaccgucgccagcucgcuggugcucguggucucccugggggccaucagcuucuggaugugcuccaacggcagccugcagugccgcaucugcaucuga

SEQ ID NO: 4796 - RNA, 1701 nt, Artificial Sequence; identical to SEQ ID NO: 3156
  derived and/or modified CDS sequence (AUadapt) from InfluenzaA__ADF27374__HA

SEQ ID NO: 4797 - RNA, 1701 nt, Artificial Sequence
  derived and/or modified CDS sequence (AUadapt) from InfluenzaA__ADF27375__HA
auggaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcuccucgcgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccucgcugcccuuccacaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcucgggguacgccgccgaccagaaguccacgcagaacgcgaucgacgagaucaccaacaagaucaacagcgugaucgagaagaugaacacccaguucaccgccgucggcaaggaguucaaccaccucgagaagcgcaucgagaaccugaacaagaagguggacgacggcuuccuggacaucuggacguacaacgccgagcuccugguccugcucgagaacgagcggacccuggacuaccacgacuccaacgugaagaaccuguacgagaaggugcgcucgcagcucaagaacaacgccaaggagaucgggaacggcugcuucgaguucuaccacaagugcgacaacacgugcauggaguccgucaagaacgggaccuacgacuaccccaaguacagcgaggaggccaagcugaaccgggaggagaucgacggcgugaagcuggaguccacccgcaucuaccagauccucgcgaucuacucgaccguggccagcucccugguccugguggugucgcucggggccaucuccuucuggaugugcagcaacggcucccugcagugccggaucugcaucuga

SEQ ID NO: 4798 - RNA, 1701 nt, Artificial Sequence
  derived and/or modified CDS sequence (AUadapt) from InfluenzaA__ADF27376__HA
augaaggccauccuggugguccuccuguacaccuucgugaccgccaacgcggacacgcugugcaucggcuaccacgccaacaacucgaccgacaccguggacaccguccucgagaagaacgugacggugacccacuccgucaaccugcuggaggacaagcacaacgggaagcucugcaagcugcgcggcguggcgccccugcaccucgggaagugcaacaucgccggcuggauccuggggaacccggagugcgagagccuguccaccgccucguccuggagcuacaucguggagaccuccaacucggacaacggcacgugcuaccccggcgacuucaucgacuacgaggagcuccgggagcagcuguccagcgucuccucguucgagcgcuucgagaucuuccccaagaccuccagcuggcccaaccacgacuccaacaagggggugaccgccgccugcccgcacgccggcgccaagucguucuacaagaaccugaucuggcucgugaagaaggggaacuccuaccccaagcugagcaaguccuacaucaacgacaagggcaaggagguccuggugcucugggggauccaccaccccucgaccagcgcggaccagcagucccuguaccagaacgccgacgccuacguguucgucggcacgucgcgguacuccaagaaguucaagcccgagaucgagauccgcccgaaggugcgggaccaggagggccgcaugaacuacuacuggacccugguggagcccggggacaagaucaccuucgaggccaccggcaaccucgucgugccccgguacgccuucgcgauggagcgcaacgccgggagcggcaucaucaucuccgacacgcccgugcacgacugcaacacgaccugccagaccccgaagggcgccaucaacaccucgcugcccuuccagaacauccaccccaucaccaucgggaagugccccaaguacgucaaguccaccaagcugcggcucgccaccggccugcgcaacgugccgagcauccagucccgggggcuguucggcgccaucgcgggguucaucgagggcggcuggacggggaugguggacggcugguacggguaccaccaccagaacgagcagggcucgggguacgccgccgaccucaaguccacccagaacgccaucgacaagaucaccaacaaggucaacagcgugaucgagaagaugaacacccaguucacggccgucggcaaggaguucaaccaccuggagaagcgcaucgagaaccugaacaagaagguggacgacggcuuccucgacaucuggaccuacaacgcggagcugcuggugcuccuggagaacgagcggacccuggacuaccacgacuccaacgucaagaaccucuacgagaaggugcgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgucaagcucgaguccacccgcaucuaccagauccuggccaucuacucgaccguggccuccagccuggugcucgucgugucgcugggggcgaucuccuucuggaugugcagcaacggcucccugcagugccggaucugcaucuga

SEQ ID NO: 4799 - RNA, 1701 nt, Artificial Sequence
  derived and/or modified CDS sequence (AUadapt) from InfluenzaA__ADF27378__HA
augaaggccauccuggugguccuccuguacaccuucgugaccgccaacgcggacacgcugugcaucggcuaccacgccaacaacucgaccgacaccguggacaccguccucgagaagaacgugacggugacccacuccgucaaccugcuggaggacaagcacaacgggaagcucugcaagcugcgcggcguggcgccccugcaccucgggaagugcaacaucgccggcuggauccuggggaacccggagugcgagagccuguccaccgccucguccuggagcuacaucguggagaccuccaacucggacaacggcacgugcuaccccggcgacuucaucgacuacgaggagcuccgggagcagcuguccagcgucuccucguucgagcgcuucgagaucuuccccaagaccuccagcuggcccaaccacgacuccaacaagggggugaccgccgccugcccgcacgccggcgccaagucguucuacaagaaccugaucuggcucgugaagaaggggaacuccuaccccaagcugagcaaguccuacaucaacgacaagggcaaggagguccuggugcucugggggauccaccaccccucgaccagcgcggaccagcagucccuguaccagaacgccgacgccuacguguucgucggcacgucgcgguacuccaagaaguucaagcccgagaucgccauccgcccgaaggugcgggaccaggagggccgcaugaacuacuacuggacccugguggagcccggggacaagaucaccuucgaggccaccggcaaccucgucgugccccgguacgcguucgccauggagcgcaacgccgggagcggcaucaucaucuccgacacgcccgugcacgacugcaacacgaccugccagaccccgaagggcgccaucaacaccucgcugcccuuccagaacauccaccccaucaccaucgggaagugccccaaguacgucaaguccaccaagcugcggcucgccaccggccugcgcaacgugccgagcauccagucccgggggcuguucggcgcgaucgccggguucaucgagggcggcuggacggggaugguggacggcugguacggguaccaccaccagaacgagcagggcucgggguacgccgccgaccucaaguccacccagaacgccaucgacaagaucaccaacaaggucaacagcgugaucgagaagaugaacacccaguucacggcggucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacuccaacgucaagaaccucuacgagaaggugcgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgucaagcucgaguccacccgcaucuaccagauccuggccaucuacucgaccguggcguccagccuggugcucgucgugucgcugggggccaucuccuucuggaugugcagcaacggcucccugcagugccggaucugcaucuga

SEQ ID NO: 4800 - RNA, 1701 nt, Artificial Sequence
  derived and/or modified CDS sequence (AUadapt) from InfluenzaA__ADF27389__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucacgucggacacccccgugcacgacugcaacacgaccugccagaccccgaagggcgccaucaacaccucccugcccuuccagaacauccaccccaucaccaucgggaagugccccaaguacgucaagagcaccaagcugcggcucgcgacgggccugcgcaacgugccguccauccagucgcgggggcuguucggcgccaucgccggguucaucgagggcggcuggaccgggaugguggacggcugguacggguaccaccaccagaacgagcagggcuccggguacgccgccgaccucaagucgacccagaacgcgaucgacgagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 4801 - RNA, 1701 nt, Artificial Sequence
  derived and/or modified CDS sequence (AUadapt) from InfluenzaA__ADF27399__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucggggagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 4802 - RNA, 1701 nt, Artificial Sequence; identical to SEQ ID NO: 4078
  derived and/or modified CDS sequence (AUadapt) from InfluenzaA__ADF27409__HA

SEQ ID NO: 4803 - RNA, 1701 nt, Artificial Sequence; identical to SEQ ID NO: 4786
  derived and/or modified CDS sequence (AUadapt) from InfluenzaA__ADF27419__HA

SEQ ID NO: 4804 - RNA, 1701 nt, Artificial Sequence
  derived and/or modified CDS sequence (AUadapt) from InfluenzaA__ADF27429__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaaguucuacaucaacgacaagggcaaggaggugcugguccucugggggauccaccaccccucgaccagcgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggucgggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgcgaccggccugcgcaacgucccgucgauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacaagaucaccaacaaggugaacucggucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcaugaaguccgugaagaacgggaccuacgacuaccccaaguacucggaggaggccaagcugaaccgggaggagaucgacggcgugaagcucgaguccacccgcaucuaccagauccuggcgaucuacagcaccgucgccuccucgcuggugcucguggucagccugggggccaucuccuucuggaugugcagcaacggcucccugcagugccggaucugcaucuga

SEQ ID NO: 4805 - RNA, 1701 nt, Artificial Sequence; identical to SEQ ID NO: 116
  derived and/or modified CDS sequence (AUadapt) from InfluenzaA__ADF27439__HA

SEQ ID NO: 4806 - RNA, 1701 nt, Artificial Sequence
  derived and/or modified CDS sequence (AUadapt) from InfluenzaA__ADF27449__HA
augaaggccauccuggugguccuccuguacaccuucgccaccgugaacgcggacacgcugugcaucggcuaccacgccaacaacucgaccgacaccguggacaccguccucgagaagaacgugacggugacccacuccgucaaccugcuggaggacaagcacaacgggaagcucugcaagcugcgcggcguggcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgucucguccuucgagcgcuucgagaucuuccccaagaccagcuccuggcccaaccacgacucgaacaagggggugaccgccgccugcccgcacgccggcgccaaguccuucuacaagaaccugaucuggcucgugaagaaggggaacagcuaccccaagcuguccaagucguacaucaacgacaagggcaaggagguccuggugcucugggggauccaccaccccagcaccuccgcggaccagcagucgcuguaccagaacgccgacgccuacguguucgucggcacgucccgguacagcaagaaguucaagcccgagaucgccauccgcccgaaggugcgggaccaggagggccgcaugaacuacuacuggacccugguggagcccggggacaagaucaccuucgaggccaccggcaaccucgucgugccccgguacgcguucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgccaccggccugcgcaacaucccguccauccagucgcgggggcuguucggcgcgaucgccggguucaucgagggcggcuggacggggaugguggacggcugguacggguaccaccaccagaacgagcagggcuccggguacgccgccgaccucaagagcacccagaacgccaucgacgagaucaccaacaaggugaacuccgucaucgagaagaugaacacccaguucacggcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgacccgcaucuaccagauccuggccaucuacuccaccgucgcgagcucgcuggugcucguggucucccugggggccaucagcuucuggaugugcuccaacggcagccugcagugccggaucugcaucuga

SEQ ID NO: 4807 - RNA, 1701 nt, Artificial Sequence; identical to SEQ ID NO: 4074
  derived and/or modified CDS sequence (AUadapt) from InfluenzaA__ADF27459__HA

SEQ ID NO: 4808 - RNA, 1701 nt, Artificial Sequence; identical to SEQ ID NO: 116
  derived and/or modified CDS sequence (AUadapt) from InfluenzaA__ADF27469__HA

SEQ ID NO: 4809 - RNA, 1701 nt, Artificial Sequence
  derived and/or modified CDS sequence (AUadapt) from InfluenzaA__ADF27479__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccacagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 4810 - RNA, 1701 nt, Artificial Sequence
  derived and/or modified CDS sequence (AUadapt) from InfluenzaA__ADF27489__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaguacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucggggagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgacccgcaucuaccagauccuggcgaucuacuccaccgucgccagcucgcuggugcucguggucucccugggggccaucagcuucuggaugugcuccaacggcagccugcagugccggaucugcaucuga

SEQ ID NO: 4811 - RNA, 1701 nt, Artificial Sequence; identical to SEQ ID NO: 4078
  derived and/or modified CDS sequence (AUadapt) from InfluenzaA__ADF27499__HA

SEQ ID NO: 4812 - RNA, 1701 nt, Artificial Sequence; identical to SEQ ID NO: 116
  derived and/or modified CDS sequence (AUadapt) from InfluenzaA__ADF27509__HA

SEQ ID NO: 4813 - RNA, 1701 nt, Artificial Sequence; identical to SEQ ID NO: 4511
  derived and/or modified CDS sequence (AUadapt) from InfluenzaA__ADF27529__HA

SEQ ID NO: 4814 - RNA, 1701 nt, Artificial Sequence; identical to SEQ ID NO: 4086
  derived and/or modified CDS sequence (AUadapt) from InfluenzaA__ADF27539__HA

SEQ ID NO: 4815 - RNA, 1701 nt, Artificial Sequence; identical to SEQ ID NO: 4086
  derived and/or modified CDS sequence (AUadapt) from InfluenzaA__ADF27549__HA

SEQ ID NO: 4816 - RNA, 1701 nt, Artificial Sequence; identical to SEQ ID NO: 116
  derived and/or modified CDS sequence (AUadapt) from InfluenzaA__ADF27559__HA

SEQ ID NO: 4817 - RNA, 1701 nt, Artificial Sequence
  derived and/or modified CDS sequence (AUadapt) from InfluenzaA__ADF27569__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcgugaacuacuacuggacccugguggagcccggggacaagaucaccuucgaggcgaccggcaaccucgucgugccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggucaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgucaagcucgagagcacccgcaucuaccagauccuggcgaucuacuccaccguggccucgagccuggugcucgucgugucccugggggccaucucguucuggaugugcuccaacggcagccugcagugccggaucugcaucuga

SEQ ID NO: 4818 - RNA, 1701 nt, Artificial Sequence; identical to SEQ ID NO: 4086
  derived and/or modified CDS sequence (AUadapt) from InfluenzaA__ADF27579__HA

SEQ ID NO: 4819 - RNA, 1701 nt, Artificial Sequence
  derived and/or modified CDS sequence (AUadapt) from InfluenzaA__ADF27589__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacguccgugcacgacugcaacacgaccugccagacccccaagggcgccaucaacaccagccugccguuccagaacauccaccccaucaccaucgggaagugccccaaguacgugaaguccaccaagcugcggcucgcgaccggccugcgcaacguccccucgauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacucggucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuacccgaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 4820 - RNA, 1701 nt, Artificial Sequence
  derived and/or modified CDS sequence (AUadapt) from InfluenzaA__ADF27599__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucacgauggagcgcaacgccggguccggcaucaucaucucggacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagucgcgggggcuguucggcgcgaucgccggguucaucgagggcggcuggaccgggaugguggacggcugguacggguaccaccaccagaacgagcagggcuccggguacgccgccgaccucaagagcacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgagaagguccgcucccagcucaagagcaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcuggaguccacccgcaucuaccagauccuggccaucuacagcaccgucgcgucgucccuggugcucguggucagccugggggccaucuccuucuggaugugcagcaacggcucccugcagugccggaucugcaucuga

SEQ ID NO: 4821 - RNA, 1701 nt, Artificial Sequence
  derived and/or modified CDS sequence (AUadapt) from InfluenzaA__ADF27609__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcaggccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 4822 - RNA, 1701 nt, Artificial Sequence
  derived and/or modified CDS sequence (AUadapt) from InfluenzaA__ADF27619__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgugccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgucucguccuucgagcgcuucgagaucuuccccaagaccagcuccuggcccaaccacgacucgaacaagggggugaccgcggccugcccgcacgccggcgccaaguccuucuacaagaaccugaucuggcucgugaagaaggggaacagcuaccccaagcuguccaagucguacaucaacgacaagggcaaggagguccuggugcucugggggauccaccaccccagcaccuccgcggaccagcagucgcuguaccagaacgccgacgccuacguguucgucggcacgucccgguacagcaagaaguucaagcccgagaucgccauccgcccgaaggugcgggaccaggagggccgcaugaacuacuacuggacccugguggagcccggggacaagaucaccuucgaggccaccggcaaccucgucgugccccgguacgcguucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgccaccggccugcgcaacgugccguccauccagucgcgggggcuguucggcgcgaucgccggguucaucgagggcggcuggacggggaugguggacggcugguacggguaccaccaccagaacgagcagggcuccggguacgccgccgaccucaagagcacccagaacgccaucgacaagaucaccaacaaggucaacuccgugaucgagaagaugaacacccaguucacggcggucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacucgaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagucgacccgcaucuaccagauccuggccaucuacuccaccguggcgagcucgcuggugcucgucgugucccugggggccaucagcuucuggaugugcuccaacggcagccugcagugccggaucugcaucuga

SEQ ID NO: 4823 - RNA, 1701 nt, Artificial Sequence; identical to SEQ ID NO: 4086
  derived and/or modified CDS sequence (AUadapt) from InfluenzaA__ADF27629__HA

SEQ ID NO: 4824 - RNA, 1701 nt, Artificial Sequence
  derived and/or modified CDS sequence (AUadapt) from InfluenzaA__ADF27649__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagccccgggggcuguucggcgccaucgccggguucaucgagggcggcuggacggggaugguggacggcugguacggguaccaccaccagaacgagcagggcucgggguacgccgccgaccucaaguccacccagaacgcgaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 4825 - RNA, 1701 nt, Artificial Sequence; identical to SEQ ID NO: 4086
  derived and/or modified CDS sequence (AUadapt) from InfluenzaA__ADF27659__HA

SEQ ID NO: 4826 - RNA, 1701 nt, Artificial Sequence; identical to SEQ ID NO: 4563
  derived and/or modified CDS sequence (AUadapt) from InfluenzaA__ADF27669__HA

SEQ ID NO: 4827 - RNA, 1701 nt, Artificial Sequence; identical to SEQ ID NO: 4015
  derived and/or modified CDS sequence (AUadapt) from InfluenzaA__ADF27679__HA

SEQ ID NO: 4828 - RNA, 1701 nt, Artificial Sequence; identical to SEQ ID NO: 4624
  derived and/or modified CDS sequence (AUadapt) from InfluenzaA__ADF27689__HA

SEQ ID NO: 4829 - RNA, 1701 nt, Artificial Sequence
  derived and/or modified CDS sequence (AUadapt) from InfluenzaA__ADF27699__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagauguuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacaacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagguggggaacggcugcuucgaguucuaccacaagugcgacaacacgugcauggagucggugaagaacgggaccuacgacuaccccaaguacuccgaggaggccaagcugaaccgggaggagaucgacggcgucaagcucgagagcacccgcaucuaccagauccuggcgaucuacuccaccguggccucgagccuggugcucgucgugucccugggggccaucucguucuggaugugcuccaacggcagccugcagugccggaucugcaucuga

SEQ ID NO: 4830 - RNA, 1701 nt, Artificial Sequence
  derived and/or modified CDS sequence (AUadapt) from InfluenzaA__ADF27709__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaucuccucguccgacaacgggaccugcuaccccggcgacuucaucaacuacgaggagcuccgggagcagcugagcuccgugucguccuucgagcgcuucgagaucuuccccaagacgagcuccuggcccaaccacgacucgaacaagggcgucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcaccucccgguacagcaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccggguccggcaucaucaucucggacacccccgugcacgacugcaacacgaccugccagaccccgaagggcgccaucaacaccucccugcccuuccagaacauccaccccaucacgaucgggaagugccccaaguacgucaagagcaccaagcugcggcucgcgaccggccugcgcaacgugccguccauccagucgcgggggcuguucggcgccaucgccggguucaucgagggcggcuggaccgggaugguggacggcugguacggguaccaccaccagaacgagcagggcuccggguacgccgccgaccucaagagcacgcagaacgcgaucgacaagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgacccgcaucuaccagauccuggcgaucuacuccaccgucgccagcucgcuggugcucguggucucccugggggccaucagcuucuggaugugcuccaacggcagccugcagugccggaucugcaucuga

SEQ ID NO: 4831 - RNA, 1701 nt, Artificial Sequence; identical to SEQ ID NO: 4078
  derived and/or modified CDS sequence (AUadapt) from InfluenzaA__ADF27785__HA

SEQ ID NO: 4832 - RNA, 1701 nt, Artificial Sequence
  derived and/or modified CDS sequence (AUadapt) from InfluenzaA__ADF27795__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccuggugaagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 4833 - RNA, 1701 nt, Artificial Sequence; identical to SEQ ID NO: 4086
  derived and/or modified CDS sequence (AUadapt) from InfluenzaA__ADF27805__HA

SEQ ID NO: 4834 - RNA, 1701 nt, Artificial Sequence
  derived and/or modified CDS sequence (AUadapt) from InfluenzaA__ADF27815__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgacggcgccaaguccuucuacaagaaccugaucuggcucgugaagaaggggaacucguaccccaagcuguccaagagcuacaucaacgacaagggcaaggaggugcugguccucugggggauccaccaccccucgaccuccgcggaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggccaccggcaaccucguggucccccgguacgcguucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgccaccggccugcgcaacgugccguccauccagagccgggggcuguucggcgcgaucgccggguucaucgagggcggcuggacggggaugguggacggcugguacggguaccaccaccagaacgagcagggcuccggguacgccgccgaccucaagucgacccagaacgccaucgacaagaucaccaacaaggugaacuccgucaucgagaagaugaacacccaguucacggcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggccaucuacuccaccgucgcgucgagccuggugcucguggucucccugggggccaucucguucuggaugugcuccaacggcagccugcagugccggaucugcaucuga

SEQ ID NO: 4835 - RNA, 1701 nt, Artificial Sequence
  derived and/or modified CDS sequence (AUadapt) from InfluenzaA__ADF27825__HA
augaaggccauccuggugguccuccuguacaccuucgccaccgcgaacgccgacacgcugugcaucggcuaccacgccaacaacucgaccgacaccguggacaccgugcucgagcgcaacgucacggugacccacuccgugaaccugcuggaggacaagcacaacgggaagcucugcaagcugcggggcgucgcgccccugcaccucgggaagugcaacaucgccggcuggauccuggggaacccggagugcgagucgcuguccaccgcgagcuccuggucguacaucguggagaccuccagcuccgacaacggcacgugcuaccccggcgacuucaucgacucggaggagcuccgcgagcagcuguccagcguguccucguucgagcgguucgagaucuuccccaagaccuccagcuggcccaaccacgacuccaacaagggggucaccgccgccugcccgcacgccggcgccaagucguucuacaagaaccugaucuggcucgugaagaaggggaacuccuaccccaagcugagcaagucguacaucaacgacaagggcaaggaggugcugguccucugggggauccaccaccccuccaccagcgccgaccagcagucccuguaccagaacgccgacgccuacguguucgugggcacgucgcgcuacuccaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccgggagcggcaucaucaucuccgacacgcccgugcacgacugcaacacgaccugccagaccccgaagggcgccaucaacaccucgcugcccuuccagaacauccaccccaucaccaucgggaagugccccaaguacgugaaguccaccaagcugcgccucgcgaccggccugcggaacgucccgagcauccagucccgcgggcuguucggcgccaucgccggguucaucgagggcggcuggacggggaugguggacggcugguacggguaccaccaccagaacgagcagggcucgggguacgccgccgaccucaaguccacccagaacgcgaucgacgagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaacgugaagaaccucuacgagaagguccggucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgugaagcucgaguccacccggaucuaccagauccuggcgaucuacucgaccgucgccagcucccuggugcucguggucucgcugggggccaucuccuucuggaugugcagcaacggcucccugcagugccgcaucugcaucuga

SEQ ID NO: 4836 - RNA, 1701 nt, Artificial Sequence
  derived and/or modified CDS sequence (AUadapt) from InfluenzaA__ADF27845__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgccaaccugcuggaggacaagcacaacgggaagcucugcaagcugcgcggcguggcgccccugcaccucgggaagugcaacaucgccggcuggauccuggggaacccggagugcgagucgcuguccaccgccagcuccuggucguacaucgucgagaccuccagcuccgacaacggcacgugcuaccccggcgacuucaucgacuacgaggagcuccgggagcagcugucguccgugucguccuucgagcgcuucgagaucuuccccaagaccagcuccuggcccaaccacgacucgaacaagggggugaccgccgccugcccgcacgcgggcgccaaguccuucuacaagaaccugaucuggcucgucaagaaggggaacagcuaccccaagcuguccaagucguacaucaacgacaagggcaaggaggugcuggugcucugggggauccaccaccccagcaccaacgccgaccagcagucccuguaccagaacgccgacgccuacgucuucgugggcacgucgcgguacuccaagaaguucaagcccgagaucgcgauccgcccgaaggugcgggaccaggagggccgcaugaacuacuacuggacccuggucgagcccggggacaagaucaccuucgaggccaccggcaaccucguggugccccgguacgccuucgccauggagcgcaacgccgggucgggcaucaucaucuccgacacgcccguccacgacugcaacacgaccugccagaccccgaagggcgcgaucaacaccagccugcccuuccagaacauccaccccaucaccaucgggaagugccccaaguacgugaaguccaccaagcugcggcucgccaccggccugcgcaacgugccgucgauccagucccgggggcuguucggcgccaucgccggguucaucgagggcggcuggacggggauggucgacggcugguacggguaccaccaccagaacgagcagggcagcggguacgccgcggaccucaaguccacccagaacgccaucgacgagaucaccaacaaggugaacucggugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcucgcagcugaagaacaacgccaaggagaucgggaacggcugcuucgaguucuaccacaagugcgacaacacgugcauggaguccgucaagaacgggaccuacgacuaccccaaguacagcgaggaggcgaagcugaaccgggaggagaucgacggcgugaagcucgaguccacccgcaucuaccagauccuggccaucuacucgaccguggccuccagccugguccucguggugucgcugggggccaucuccuucuggaugugcagcaacggcucccugcagugccggaucugcaucuga

SEQ ID NO: 4837 - RNA, 1701 nt, Artificial Sequence; identical to SEQ ID NO: 4078
  derived and/or modified CDS sequence (AUadapt) from InfluenzaA__ADF27855__HA

SEQ ID NO: 4838 - RNA, 1701 nt, Artificial Sequence; identical to SEQ ID NO: 4078
  derived and/or modified CDS sequence (AUadapt) from InfluenzaA__ADF27865__HA

SEQ ID NO: 4839 - RNA, 1701 nt, Artificial Sequence; identical to SEQ ID NO: 4078
  derived and/or modified CDS sequence (AUadapt) from InfluenzaA__ADF27875__HA

SEQ ID NO: 4840 - RNA, 1701 nt, Artificial Sequence; identical to SEQ ID NO: 4078
  derived and/or modified CDS sequence (AUadapt) from InfluenzaA__ADF27885__HA

SEQ ID NO: 4841 - RNA, 1701 nt, Artificial Sequence; identical to SEQ ID NO: 116
  derived and/or modified CDS sequence (AUadapt) from InfluenzaA__ADF27895__HA

SEQ ID NO: 4842 - RNA, 1701 nt, Artificial Sequence
  derived and/or modified CDS sequence (AUadapt) from InfluenzaA__ADF27915__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucggccuccgccgaccagcagagccuguaccagaacgccgacgccuacguguucgugggcaccucccgguacucgaagaaguucaagcccgagaucgcgauccgcccgaagguccgggaccaggagggccgcaugaacuacuacuggacgcugguggagcccggggacaagaucaccuucgaggccaccggcaaccucguggucccccgguacgccuucgccauggagcgcaacgccggguccggcaucaucaucagcgacacccccgugcacgacugcaacacgaccugccagaccccgaagggcgcgaucaacaccucccugcccuuccagaacauccaccccaucacgaucgggaagugccccaaguacgucaagucgaccaagcugcggcucgccaccggccugcgcaacgugccguccauccagagccgggggcuguucggcgccaucgccggguucaucgagggcggcuggaccgggaugguggacggcugguacggguaccaccaccagaacgagcagggcuccggguacgccgcggaccucaagucgacgcagaacgccaucgacaagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggcgaagcugaaccgggaggagaucgacggcgugaagcucgagagcacccgcaucuaccagauccuggccaucuacuccaccgucgccucgagccuggugcucguggucucccugggggccaucucguucuggaugugcuccaacggcagccugcagugccggaucugcaucuga

SEQ ID NO: 4843 - RNA, 1701 nt, Artificial Sequence
  derived and/or modified CDS sequence (AUadapt) from InfluenzaA__ADF27925__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggucaccgccgccugcccgcacgccggcgcgaaguccuucuacaagaaccugaucuggcucgugaagaaggggaacagcuaccccaagcuguccaacucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgcccacgacugcaacacgaccugccagaccccgaagggcgcgaucaacaccucccugcccuuccagaacauccaccccaucaccaucgggaagugccccaaguacgucaagagcaccaagcugcggauggccaccggccuccgcaacgugccguccauccagucgcgggggcuguucggcgccaucgccggguucaucgagggcggcuggacggggaugguggacggcugguacggguaccaccaccagaacgagcagggcuccggguacgccgcggaccucaagucgacccagaacgccaucgacgagaucaccaacaaggugaacuccgugaucgagaagaugaacacccaguucacggccgucggcaaggaguucaaccaccuggagaagcgcaucgagaaccugaacaagaagguggacgacggcuuccuggacaucuggaccuacaacgccgagcuccugguccugcucgagaacgagcggacccuggacuaccacgacagcaacgugaagaaccuguacgagaaggugcgcucccagcucaagaacaacgccaaggagaucgggaacggcugcuucgaguucuaccacaagugcgacaacacgugcauggagucggucaagaacgggaccuacgacuaccccaaguacuccgaggaggcgaagcugaaccgggaggagaucgacggcgugaagcuggagagcacccgcaucuaccagauccucgccaucuacuccaccguggccucgagccugguccugguggugucccucggggccaucucguucuggaugugcuccaacggcagccugcagugccggaucugcaucuga

SEQ ID NO: 4844 - RNA, 1701 nt, Artificial Sequence
  derived and/or modified CDS sequence (AUadapt) from InfluenzaA__ADF27935__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccgaagugcgagucgcuguccaccgagagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacagcaacaagggggucaccgccgccugcccgcacgccggcgccaaguccuucuacaagaaccugaucuggcucgugaagaaggggaacucguaccccaagcuguccaagagcuacaucaacgacaagggcaaggaggugcugguccucugggggauccaccaccccucgaccuccgcggaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggccaccggcaaccucguggucccccgguacgcguucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgccaccggccugcgcaacgugccguccauccagagccgggggcuguucggcgcgaucgccggguucaucgagggcggcuggacggggaugguggacggcugguacggguaccaccaccagaacgagcagggcuccggguacgccgccgaccucaagucgacccagaacgccaucgacaagaucaccaacaaggugaacuccgucaucgagaagaugaacacccaguucacggcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggccaucuacuccaccgucgcgucgagccuggugcucguggucucccugggggccaucucguucuggaugugcuccaacggcagccugcagugccggaucugcaucuga

SEQ ID NO: 4845 - RNA, 1701 nt, Artificial Sequence
  derived and/or modified CDS sequence (AUadapt) from InfluenzaA__ADF27955__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaacagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 4846 - RNA, 1701 nt, Artificial Sequence
  derived and/or modified CDS sequence (AUadapt) from InfluenzaA__ADF27965__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaagaaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugaacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 4847 - RNA, 1701 nt, Artificial Sequence; identical to SEQ ID NO: 4078
  derived and/or modified CDS sequence (AUadapt) from InfluenzaA__ADF27975__HA

SEQ ID NO: 4848 - RNA, 1701 nt, Artificial Sequence; identical to SEQ ID NO: 4086
  derived and/or modified CDS sequence (AUadapt) from InfluenzaA__ADF27985__HA

SEQ ID NO: 4849 - RNA, 1701 nt, Artificial Sequence
  derived and/or modified CDS sequence (AUadapt) from InfluenzaA__ADF27995__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgccaaccugcuggaggacaagcacaacgggaagcucugcaagcugcgcggcguggcgccccugcaccucgggaagugcaacaucgccggcuggauccuggggaacccggagugcgagucgcuguccaccgccagcuccuggucguacaucgucgagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggugaccgccgccugcccgcacgcgggcgccaaguccuucuacaagaaccugaucuggcucgucaagaaggggaacucguaccccaagcuguccaagagcuacaucaacgacaagggcaaggaggugcuggugcucugggggauccaccaccccucgaccaacgccgaccagcagucccuguaccagaacgccgacgccuacgucuucgugggcacgucgcgguacuccaagaaguucaagcccgagaucgcgauccgcccgaaggugcgggaccaggagggccgcaugaacuacuacuggacccuggucgagcccggggacaagaucaccuucgaggccaccggcaaccucguggugccccgguacgccuucgccauggagcgcaacgccgggagcggcaucaucaucuccgacacgcccgcgcacgacugcaacacgaccugccagaccccgaagggcgccaucaacaccucgcugcccuuccagaacauccaccccaucaccaucgggaagugccccaaguacgucaaguccaccaagcugcggcucgccaccggccugcgcaacaucccgagcauccagucccgggggcuguucggcgccaucgccggguucaucgagggcggcuggacggggaugguggacggcugguacggguaccaccaccagaacgagcagggcucgggguacgcggccgaccucaaguccacccagaacgccaucgacgagaucaccaacaaggugaacucggucaucgagaagaugaacacccaguucacggccgugggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaagguccgcagccagcugaagaacaacgcgaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggccaucuacucgaccgucgccuccagccuggugcucguggucucgcugggggcgaucuccuucuggaugugcagcaacggcucccugcagugccggaucugcaucuga

SEQ ID NO: 4850 - RNA, 1701 nt, Artificial Sequence; identical to SEQ ID NO: 4466
  derived and/or modified CDS sequence (AUadapt) from InfluenzaA__ADF28005__HA

SEQ ID NO: 4851 - RNA, 1701 nt, Artificial Sequence; identical to SEQ ID NO: 4466
  derived and/or modified CDS sequence (AUadapt) from InfluenzaA__ADF28015__HA

SEQ ID NO: 4852 - RNA, 1701 nt, Artificial Sequence; identical to SEQ ID NO: 4078
  derived and/or modified CDS sequence (AUadapt) from InfluenzaA__ADF28025__HA

SEQ ID NO: 4853 - RNA, 1701 nt, Artificial Sequence; identical to SEQ ID NO: 4078
  derived and/or modified CDS sequence (AUadapt) from InfluenzaA__ADF28045__HA

SEQ ID NO: 4854 - RNA, 1701 nt, Artificial Sequence
  derived and/or modified CDS sequence (AUadapt) from InfluenzaA__ADF28055__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaacuacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgacccgcaucuaccagauccuggcgaucuacuccaccgucgccagcucgcuggugcucguggucucccugggggccaucagcuucuggaugugcuccaacggcagccugcagugccggaucugcaucuga

SEQ ID NO: 4855 - RNA, 1701 nt, Artificial Sequence; identical to SEQ ID NO: 4078
  derived and/or modified CDS sequence (AUadapt) from InfluenzaA__ADF28065__HA

SEQ ID NO: 4856 - RNA, 1701 nt, Artificial Sequence; identical to SEQ ID NO: 3096
  derived and/or modified CDS sequence (AUadapt) from InfluenzaA__ADF28075__HA

SEQ ID NO: 4857 - RNA, 1701 nt, Artificial Sequence; identical to SEQ ID NO: 4015
  derived and/or modified CDS sequence (AUadapt) from InfluenzaA__ADF28085__HA

SEQ ID NO: 4858 - RNA, 1701 nt, Artificial Sequence; identical to SEQ ID NO: 96
  derived and/or modified CDS sequence (AUadapt) from InfluenzaA__ADF28107__HA

SEQ ID NO: 4859 - RNA, 1701 nt, Artificial Sequence; identical to SEQ ID NO: 4466
  derived and/or modified CDS sequence (AUadapt) from InfluenzaA__ADF28117__HA

SEQ ID NO: 4860 - RNA, 1701 nt, Artificial Sequence
  derived and/or modified CDS sequence (AUadapt) from InfluenzaA__ADF29918__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcugucccggagcuacaucaacgacaagggcaaggaggugcugguccucugggggauccaccaccccucgaccuccgccgaccagcagagccuguaccagaacgccgacgccuacguguucgugggcacgucccgcuacucgaagaaguucaagcccgagaucgccauccggccgaagguccgcaaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggcgaucuacuccaccgucgccucgagccuggugcucguggucucccugggggccaucucguucuggaugugcuccaacggcagccugcagugccgcaucugcaucuga

SEQ ID NO: 4861 - RNA, 1701 nt, Artificial Sequence
  derived and/or modified CDS sequence (AUadapt) from InfluenzaA__ADF42689__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgacccgcaucuaccagauccuggcgaucuacuccaccgucgccagcucgcuggugcucgccgugucccugggggccaucggcuucuggaugugcagcaacggcucccugcagugccggaucugcaucuga

SEQ ID NO: 4862 - RNA, 1701 nt, Artificial Sequence
  derived and/or modified CDS sequence (AUadapt) from InfluenzaA__ADF42699__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggacccucugcaagcugcgcggcgucgcgccccugcaccucgggaagugcaacaucgccggcuggauccuggggaacccggagugcgagucgcuguccaccgccagcuccuggucguacaucguggagacguccagcuccgacaacgggaccugcuaccccggcgacuucaucgacuacgaggagcuccgggagcagcugucguccgugagcuccuucgagcgcuucgagauguuccccaagaccucguccuggcccaaccacgacagcaacaagggcgucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgacguccgccgaccagcagagccuguaccagaacgccgacgccuacguguucgugggcaccucccgguacucgaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcggcucgcgacgggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagucgacccagaacgcgaucgacgagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 4863 - RNA, 1701 nt, Artificial Sequence; identical to SEQ ID NO: 4078
  derived and/or modified CDS sequence (AUadapt) from InfluenzaA__ADF42709__HA

SEQ ID NO: 4864 - RNA, 1701 nt, Artificial Sequence; identical to SEQ ID NO: 4078
  derived and/or modified CDS sequence (AUadapt) from InfluenzaA__ADF42719__HA

SEQ ID NO: 4865 - RNA, 1701 nt, Artificial Sequence; identical to SEQ ID NO: 4078
  derived and/or modified CDS sequence (AUadapt) from InfluenzaA__ADF42729__HA

SEQ ID NO: 4866 - RNA, 1701 nt, Artificial Sequence; identical to SEQ ID NO: 4078
  derived and/or modified CDS sequence (AUadapt) from InfluenzaA__ADF42739__HA

SEQ ID NO: 4867 - RNA, 1701 nt, Artificial Sequence
  derived and/or modified CDS sequence (AUadapt) from InfluenzaA__ADF58349__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccgaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggagcgcgagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggcgaucuacuccaccgucgccucgagccuggugcucguggucucccugggggccaucucguucuggaugugcuccaacggcagccugcagugccgcaucugcaucuga

SEQ ID NO: 4868 - RNA, 1701 nt, Artificial Sequence; identical to SEQ ID NO: 4511
  derived and/or modified CDS sequence (AUadapt) from InfluenzaA__ADF58351__HA

SEQ ID NO: 4869 - RNA, 1701 nt, Artificial Sequence
  derived and/or modified CDS sequence (AUadapt) from InfluenzaA__ADF80454__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccggagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccaucaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacgacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgagccugguccucguggugucccugggggccaucucguucuggaugugcuccaacggcagccugcagugccggaucugcaucuga

SEQ ID NO: 4870 - RNA, 1701 nt, Artificial Sequence
  derived and/or modified CDS sequence (AUadapt) from InfluenzaA__ADF80462__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgucguccuggagcuacaucguggagaccuccaacucggacaacggcacgugcuaccccggcgacuucaucgacuacgaggagcuccgggagcagcuguccagcguguccucguucgagcgcuucgagaucuuccccaagaucuccagcuggcccaaccacgacuccaacaagggggucaccgccgccugcccgcacgccggcgccaagucguucuacaagaaccugaucuggcucgugaagaaggggaacuccuaccccaagcugagcaaguccuacaucaacgacaagggcaaggaggugcugguccucugggggauccaccaccccucgaccagcgccgaccagcagucccuguaccagaacgccgacgccuacguguucgugggcaccucgcgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccucgcugcccuuccagaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcucgggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 4871 - RNA, 1701 nt, Artificial Sequence; identical to SEQ ID NO: 116
  derived and/or modified CDS sequence (AUadapt) from InfluenzaA__ADF80470__HA

SEQ ID NO: 4872 - RNA, 1701 nt, Artificial Sequence
  derived and/or modified CDS sequence (AUadapt) from InfluenzaA__ADF80478__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacccgaacaagggggucaccgccgccugcccccacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacguguucgugggcacgucgcgguacuccaagaaguucaagccggagaucgccauccgccccaagguccgggaccaggagggccgcaugaacuacuacuggacccugguggagcccggggacaagaucaccuucgaggcgaccggcaaccucauggugccccgguacgccuucgccauggagcgcaacgccgggagcggcaucaucaucuccgacacgccgguccacgacugcaacacgaccugccagacccccaagggcgccaucaacaccucgcugcccuuccagaacauccaccccaucaccaucgggaagugcccgaaguacgugaaguccaccaagcugcggcucgcgaccggccugcgcaacgugcccagcauccagucccgggggcuguucggcgccaucgccggguucaucgagggcggcuggacggggauggucgacggcugguacggguaccaccaccagaacgagcagggcucgggguacgccgccgaccucaaguccacccagaacgcgaucgacgagaucaccaacaaggugaacagcgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcucgcagcugaagaacaacgccaaggagaucgggaacggcugcuucgaguucuaccacaagugcgacaacacgugcauggaguccgucaagaacgggaccuacgacuaccccaaguacagcgaggaggccaagcugaaccgggaggagaucgacggcgugaagcucgaguccacccgcaucuaccagauccuggcgaucuacucgaccguggccuccagccugguccucguggugucgcugggggccaucuccuucuggaugugcagcaacggcucccugcagugccggaucugcaucuga

SEQ ID NO: 4873 - RNA, 1701 nt, Artificial Sequence
  derived and/or modified CDS sequence (AUadapt) from InfluenzaA__ADF80494__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccuccuggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagucgaccaagcuccggcuggcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgugaucgagaagaugaacacccaguucacggccgucggcaaggaguucaaccaccuggagaagcgcaucgagaaccucaacaagaagguggacgacggcuuccuggacaucuggaccuacaacgccgagcugcucguccugcuggagaacgagcggacccucgacuaccacgacagcaacgugaagaaccuguacgagaaggugcgcucccagcugaagaccaacgccaaggagaucgggaacggcugcuucgaguucuaccacaagugcgacaacacgugcauggagucggucaagaacgggaccuacgacuaccccaaguacuccgaggaggccaagcucaaccgggaggagaucgacggcgugaagcuggagagcacccgcaucuaccagauccuggcgaucuacuccaccguggccucgagccucguccugguggugucccugggggccaucucguucuggaugugcuccaacggcagccuccagugccggaucugcaucuga

SEQ ID NO: 4874 - RNA, 1701 nt, Artificial Sequence; identical to SEQ ID NO: 4873
  derived and/or modified CDS sequence (AUadapt) from InfluenzaA__ADF80498__HA

SEQ ID NO: 4875 - RNA, 1701 nt, Artificial Sequence; identical to SEQ ID NO: 3538
  derived and/or modified CDS sequence (AUadapt) from InfluenzaA__ADF80502__HA

SEQ ID NO: 4876 - RNA, 1701 nt, Artificial Sequence
  derived and/or modified CDS sequence (AUadapt) from InfluenzaA__ADF80506__HA
augaaggccauccuggugguccuccuguacaccuucgccaccgcgaacgccgacacgcugugcaucggcuaccacgccaacaacucgaccgacaccguggacaccgugcucgagcgcaacgucacggugacccacuccgugaaccugcuggaggacaagcacaacgggaagcucugcaagcugcggggcgucgcgccccugcaccucgggaagugcucgaucgccggcuggauccuggggaacccggagugcgagucccugagcaccgccuccucgugguccuacaucguggagaccagcuccucggacaacggcacgugcuaccccggcgacuucaucgacuacgaggagcuccgcgagcagcuguccagcguguccucguucgagcgguucgagaucuuccccaagaccuccagcuggcccaaccacgacccgaacaagggggucaccgccgccugcccccacgccggcgcgaaguccuucuacaagaaccugaucuggcucgugaagaaggagaacucguaccccaagcuguccaagagcuacaucaacgacaaggggaaggaggugcugguccucuggggcauccaccaccccucgaccuccgccgaccagcagagccuguaccagaacgccgacgccuacguguucguggggacgucccgcuacucgaagaaguucaagccggagaucgccauccggcccaagguccgcgaccaggagggccggaugaacuacuacuggacccugguggagcccggcgacaagaucaccuucgaggcgaccgggaaccucguggucccccgcuacgccuucgccauggagcggaacgccggcuccgggaucaucaucagcgacacgccggugcacgacugcaacacgaccugccagacccccaagggcgccaucaacaccucccugcccuuccagaacauccaccccaucaccaucggcaagugcccgaaguacgucaagucgaccaagcugcgccucgcgaccgggcugcggaacgugcccuccauccagagccgcggccuguucggggccaucgccggcuucaucgagggcggguggacgggcaugguggacgggugguacggcuaccaccaccagaacgagcagggguccggcuacgccgccgaccucaagucgacccagaacgcgaucgacgagaucaccaacaaggugaacuccgucaucgagaagaugaacacccaguucacggccguggggaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgcgaggagaucgacggggugaagcucgagagcacccggaucuaccagauccuggcgaucuacuccaccgucgccucgagccuggugcucguggucucccugggcgccaucucguucuggaugugcuccaacgggagccugcagugccgcaucugcaucuga

SEQ ID NO: 4877 - RNA, 1701 nt, Artificial Sequence
  derived and/or modified CDS sequence (AUadapt) from InfluenzaA__ADF83741__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcaagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaagaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcagaccgccaucccgaacaucggcucgcggccccgcgugcggaacauccccucccgcaucagcaucuacuggaccaucgucaagcccggcgacauccugcucaucaacuccaccgggaaccugaucgccccgcggggcuacuucaagauccgcucggggaaguccagcgugaugcgguccgacgcccccaucggcaagugcaacucggacugcaucacgcccaacggcuccauccccaacgacaagccguuccagaacgugaaccgcaucaccuacggggcgugcccccgguacgucaagcagaacacccugaagcucgccaccggcaugcgcaacgugcccgagaagcagacgcgggggaucuucggcgccaucgccggguucaucgagaacggcugggagggcaugguggacgggugguacggcuuccgccaccagaacucggaggggcggggccaggccgcggaccugaaguccacccaggccgccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggcgugccagaaggggaacauccggugcaacaucugcaucuga

SEQ ID NO: 4878 - RNA, 1701 nt, Artificial Sequence; identical to SEQ ID NO: 3656
  derived and/or modified CDS sequence (AUadapt) from InfluenzaA__ADF83752__HA

SEQ ID NO: 4879 - RNA, 1701 nt, Artificial Sequence; identical to SEQ ID NO: 4466
  derived and/or modified CDS sequence (AUadapt) from InfluenzaA__ADF83763__HA

SEQ ID NO: 4880 - RNA, 1701 nt, Artificial Sequence; identical to SEQ ID NO: 4466
  derived and/or modified CDS sequence (AUadapt) from InfluenzaA__ADF83773__HA

SEQ ID NO: 4881 - RNA, 1701 nt, Artificial Sequence
  derived and/or modified CDS sequence (AUadapt) from InfluenzaA__ADF83783__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaccaccaucgggaagugccccaaguacgucaagagcaccaagcugcggcucgcgacgggccugcgcaacgugccguccauccagucgcgggggcuguucggcgccaucgccggguucaucgagggcggcuggaccgggaugguggacggcugguacggguaccaccaccagaacgagcagggcuccggguacgccgccgaccucaagucgacccagaacgcgaucgacgagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 4882 - RNA, 1701 nt, Artificial Sequence; identical to SEQ ID NO: 4541
  derived and/or modified CDS sequence (AUadapt) from InfluenzaA__ADF83793__HA

SEQ ID NO: 4883 - RNA, 1701 nt, Artificial Sequence
  derived and/or modified CDS sequence (AUadapt) from InfluenzaA__ADF83803__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagacccugucgaccgcguccagcugguccuacaucguggagacgucguccagcgacaacgggaccugcuaccccggcgacuucaucgacuacgaggagcuccgggagcagcuguccucgguguccucguucgagcgcuucgagaucuuccccaagaccuccagcuggcccaaccacgacuccaacaagggcgucaccgccgccugcccgcacgccggcgccaagucguucuacaagaaccugaucuggcucgugaagaaggggaacuccuaccccaagcugagcaaguccuacaucaacgacaagggcaaggaggugcugguccucugggggauccaccaccccucgacgagcgccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccagaacgugcaccccaucaccaucgggaagugccccaaguacgucaaguccaccaagcugcggcucgcgacgggccugcgcaacgugccgucgauccagucccgggggcuguucggcgccaucgccggguucaucgagggcggcuggaccgggaugguggacggcugguacggguaccaccaccagaacgagcagggcagcggguacgccgccgaccucaaguccacccagaacgcgaucgacgagaucaccaacaaggucaacucggugaucgagaagaugaacacgcaguucaccgccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacuccaacgucaagaaccucuacgagaaggugcgcucgcagcugaagaacaacgccaaggagacggggaacggcugcuucgaguucuaccacaagugcgacaacacgugcauggaguccgugaagaacgggaccuacgacuaccccaaguacagcgaggaggccaagcugaaccgggaggagaucgacggcgucaagcucgaguccacccgcaucuaccagauccuggcgaucuacucgaccguggccuccagccuggugcucgucgugucgcugggggccaucuccuucuggaugugcagcaacggcucccugcagugccggaucugcaucuga

SEQ ID NO: 4884 - RNA, 1701 nt, Artificial Sequence
  derived and/or modified CDS sequence (AUadapt) from InfluenzaA__ADF83813__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccacggaccagcagagccuguaccagaacgccgacgccuacguguucgugggcaccucccgguacucgaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggccaucuacuccaccgucgcgucgagccuggugcucguggucucccugggggccaucucguucuggaugugcuccaacggcagccugcagugccggaucugcaucuga

SEQ ID NO: 4885 - RNA, 1701 nt, Artificial Sequence
  derived and/or modified CDS sequence (AUadapt) from InfluenzaA__ADF83823__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacuccuacguguucgugggcacgagccgguacuccaagaaguucaagcccgagaucgccauccgcccgaagguccgggaccaggagggccgcaugaacuacuacuggacccugguggagcccggggacaagaucaccuucgaggccaccggcaaccucguggucccccgguacgcguucgccauggagcgcaacgccgggucgggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgccaccggccugcgcaacaucccgucgauccagucccgggggcuguucggcgcgaucgccggguucaucgagggcggcuggacggggauggucgacggcugguacggguaccaccaccagaacgagcagggcagcggguacgccgccgaccucaaguccacccagaacgccaucgacgagaucaccaacaaggugaacucggugaucgagaagaugaacacccaguucacggcggucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuaccccaaguacucggaggaggccaagcugaaccgggaggagaucgacggcgugaagcucgaguccacccgcaucuaccagauccuggccaucuacagcaccguggcgucgucccugguccucguggugagccugggggccaucuccuucuggaugugcagcaacggcucccugcagugccggaucugcaucuga

SEQ ID NO: 4886 - RNA, 1701 nt, Artificial Sequence; identical to SEQ ID NO: 4466
  derived and/or modified CDS sequence (AUadapt) from InfluenzaA__ADF83833__HA

SEQ ID NO: 4887 - RNA, 1701 nt, Artificial Sequence; identical to SEQ ID NO: 4466
  derived and/or modified CDS sequence (AUadapt) from InfluenzaA__ADF83843__HA

SEQ ID NO: 4888 - RNA, 1701 nt, Artificial Sequence; identical to SEQ ID NO: 4466
  derived and/or modified CDS sequence (AUadapt) from InfluenzaA__ADF83853__HA

SEQ ID NO: 4889 - RNA, 1701 nt, Artificial Sequence
  derived and/or modified CDS sequence (AUadapt) from InfluenzaA__ADF83873__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgaacagcugguccuacaucguggagaccucguccagcgacaacggcacgugcuaccccggcgacuucaucgacuacgaggagcuccgggagcagcuguccucgguguccagcuucgagcgcuucgagaucuuccccaagaccuccucguggcccaaccacgacuccaacaagggggucaccgccgccugcccgcacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucgacggaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccgggagcggcaucaucaucuccgacacccccgugcacgacugcaacacgaccugccagaccccgaagggcgccaucaacaccucgcugcccuuccagaacauccaccccaucaccaucgggaagugccccaaguacgugaaguccaccaagcugcggcucgccacgggccugcgcaacgucccgagcauccagucccgggggcuguucggcgcgaucgccggguucaucgagggcggcuggaccgggaugguggacggcugguacggguaccaccaccagaacgagcagggcucgggguacgccgccgaccucaaguccacccagaacgccaucgacaagaucaccaacaaggugaacagcgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggccaucuacucgaccgucgcguccagccuggugcucguggucucgcugggggccaucuccuucuggaugugcagcaacggcucccugcagugccggaucugcaucuga

SEQ ID NO: 4890 - RNA, 1701 nt, Artificial Sequence; identical to SEQ ID NO: 4078
  derived and/or modified CDS sequence (AUadapt) from InfluenzaA__ADF83885__HA

SEQ ID NO: 4891 - RNA, 1701 nt, Artificial Sequence
  derived and/or modified CDS sequence (AUadapt) from InfluenzaA__ADF83895__HA
augaaggccauccuggugguccuccuguacaccuucgccaccgugaacgcggacacgcugugcaucggcuaccacgccaacaacucgaccgacaccguggacaccguccucgagaagaacgugacggugacccacuccgucaaccugcuggaggacaagcacaacgggaagcucugcaagcugcgcggcguggcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgucucguccuucgagcgcuucgagaucuuccccaagaccagcuccuggcccaaccacgacucgaacaagggggugaccgccgccugcccgcacgccggcgccaaguccuucuacaagaaccugaucuggcucgugaagaaggggaacagcuaccccaagcuguccaagucguacaucaacgacaagggcaaggagguccuggugcucugggggauccaccaccccagcaccuccgcggaccagcagucgcuguaccagaacgccgacgccuacguguucgucggcacgucccgguacagcaagaaguucaagcccgagaucgccauccgcccgaaggugcgggaccaggagggccgcaugaacuacuacuggacccugguggagcccggggacaagaucaccuucgaggccaccggcaaccucgucgugccccgguacgcguucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgccaccggccugcgcaacgugccguccauccagucgcgggggcuguucggcgcgaucgccggguucaucgagggcggcuggacggggaugguggacggcugguacggguaccaccaccagaacgagcagggcuccggguacgccgccgaccucaagagcacccagaacgccaucgacaagaucaccaacaaggucaacuccgugaucgagaagaugaacacccaguucacggcggucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacucgaacgucaagaaccucuacgagaagauccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgacccgcaucuaccagauccuggccaucuacuccaccgucgcgagcucgcuggugcucguggucucccugggggccaucagcuucuggaugugcuccaacggcagccugcagugccggaucugcaucuga

SEQ ID NO: 4892 - RNA, 1701 nt, Artificial Sequence; identical to SEQ ID NO: 4466
  derived and/or modified CDS sequence (AUadapt) from InfluenzaA__ADF83915__HA

SEQ ID NO: 4893 - RNA, 1701 nt, Artificial Sequence
  derived and/or modified CDS sequence (AUadapt) from InfluenzaA__ADF84441__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgucguccuggagcuacaucguggagaccuccucguccgacaacggcacgugcuaccccggcgacuucaucaacuacgaggagcuccgggagcagcugagcuccgugucguccuucgagcgcuucgagaucuuccccaagaccagcuccuggcccagccacgacuccaacaagggggucaccgccgccugcccgcacgccggcgccaagucguucuacaagaaccugaucuggcucgugaagaaggggaacuccuaccccaagcugagcaagucguacaucaacgacaagggcaaggaggugcugguccucugggggauccaccaccccuccaccagcgccgaccagcagucccuguaccagaacgccgacgccuacguguucgugggcacgucgcgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccucgcugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacaagaucaccaacaaggugaacucggucaucgagaagaugaacauccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 4894 - RNA, 1701 nt, Artificial Sequence; identical to SEQ ID NO: 4078
  derived and/or modified CDS sequence (AUadapt) from InfluenzaA__ADF84459__HA

SEQ ID NO: 4895 - RNA, 1701 nt, Artificial Sequence; identical to SEQ ID NO: 4466
  derived and/or modified CDS sequence (AUadapt) from InfluenzaA__ADF84469__HA

SEQ ID NO: 4896 - RNA, 1701 nt, Artificial Sequence; identical to SEQ ID NO: 4527
  derived and/or modified CDS sequence (AUadapt) from InfluenzaA__ADF84479__HA

SEQ ID NO: 4897 - RNA, 1701 nt, Artificial Sequence; identical to SEQ ID NO: 4466
  derived and/or modified CDS sequence (AUadapt) from InfluenzaA__ADF84489__HA

SEQ ID NO: 4898 - RNA, 1701 nt, Artificial Sequence; identical to SEQ ID NO: 4466
  derived and/or modified CDS sequence (AUadapt) from InfluenzaA__ADF85017__HA

SEQ ID NO: 4899 - RNA, 1701 nt, Artificial Sequence; identical to SEQ ID NO: 4466
  derived and/or modified CDS sequence (AUadapt) from InfluenzaA__ADF87152__HA

SEQ ID NO: 4900 - RNA, 1701 nt, Artificial Sequence
  derived and/or modified CDS sequence (AUadapt) from InfluenzaA__ADF87162__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacuccuacguguucgugggcacgagcaaguacuccaagaaguucaagcccgagaucgccauccggccgaagguccgcgaccaggagggccggaugaacuacuacuggacccugguggagcccggggacaagaucaccuucgaggccaccggcaaccucguggucccccgcuacgcguucgccauggagcggaacgccgggucgggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgucgauccagucccgcgggcuguucggcgcgaucgccggguucaucgagggcggcuggacggggaugguggacggcugguacggguaccaccaccagaacgagcagggcagcggguacgccgccgaccucaaguccacccagaacgccaucgacgagaucaccaacaaggugaacucggucaucgagaagaugaacacccaguucacggcggugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgcgaggagaucgacggcgugaagcucgaguccacccggaucuaccagauccuggccaucuacagcaccgucgcgucgucccuggugcucguggucagccugggggccaucuccuucuggaugugcagcaacggcucccugcagugccgcaucugcaucuga

SEQ ID NO: 4901 - RNA, 1701 nt, Artificial Sequence; identical to SEQ ID NO: 4466
  derived and/or modified CDS sequence (AUadapt) from InfluenzaA__ADF87172__HA

SEQ ID NO: 4902 - RNA, 1701 nt, Artificial Sequence
  derived and/or modified CDS sequence (AUadapt) from InfluenzaA__ADF87182__HA
augaacgccauccuggugguccuccuguacaccuucgccaccgcgaacgccgacacgcugugcaucggcuaccacgccaacaacucgaccgacaccguggacacccuccuggagaagaacgugacggucacccacuccgugaaccugcucgaggacaagcacaacgggaagcugugcaagcugcgcggcguggcgccccuccaccuggggaagugcaacaucgccggcuggauccuggggaacccggagugcgagucgcucuccaccgccagcuccuggucguacaucgucgagaccuccagcuccgacaacggcacgugcuaccccggcgacuucaucgacuacgaggagcugcgggagcagcugucguccgugagcuccuucgagcgcuucgagaucuuccccaagaccucguccuggcccaaccacgacucgaacaagggggugaccgccgccugcccgcacgccggcgcgaaguccuucuacaagaaccucaucuggcuggucaagaaggggaacagcuaccccaagcuguccaagucguacaucaacgacaagggcaaggaggugcucgugcugugggggauccaccaccccagcaccuccgccgaccagcagucgcuguaccagaacgccgacgccuacgucuucgugggcacgucccgguacagcaagaaguucaagcccgagaucgccauccgcccgaaggugcgggaccaggagggccgcaugaacuaccacuggacccucgucgagcccggggacaagaucaccuucgaggcgaccggcaaccugguggugccccgguacgccuucgccauggagcgcaacgccggguccggcaucaucaucucggacgcccccguccacgacugcaacacgaccugccagaccccgaagggcgcgaucaacaccucccugcccuuccagaacauccaccccaucacgaucgggaagugccccaaguacgucaagagcaccaagcuccggcuggccaccggccugcgcaacgugccguccauccagucgcgggggcuguucggcgccaucgccggguucaucgagggcggcuggaccgggaugguggacggcugguacggguaccaccaccagaacgagcagggcuccggguacgccgcggaccucaagucgacgcagaacgccaucgacgagaucaccaacaagaucaacuccgugaucgagaagaugaacacccaguucaccgccgugggcaaggaguucaaccaccuggagaagcgcaucgagaaccucaacaagaaggucgacgacggcuuccuggacaucuggacguacaacgccgagcugcucgugcugcuggagaacgagcggacccucgacuaccacgacagcaacgucaagaaccuguacgagaaggugcgcucccagcugaagaacaacgccaaggagaucgggaacggcugcuucgaguucuaccacaagugcgacaacacgugcauggagucggugaagaacgggaccuacgacuaccccaaguacuccgaggaggcgaagcucaaccgggaggagaucgacggcgucaagcuggagagcacccgcaucuaccagauccuggccaucuacuccaccguggccucgagccucgugcuggucgugucccugggggccaucucguucuggaugugcuccaacggcagccuccagugccggaucugcaucuga

SEQ ID NO: 4903 - RNA, 1701 nt, Artificial Sequence; identical to SEQ ID NO: 4466
  derived and/or modified CDS sequence (AUadapt) from InfluenzaA__ADF87192__HA

SEQ ID NO: 4904 - RNA, 1701 nt, Artificial Sequence
  derived and/or modified CDS sequence (AUadapt) from InfluenzaA__ADF87202__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguucgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgacccgcaucuaccagauccuggcgaucuacuccaccgucgccagcucgcuggugcucguggucucccugggggccaucagcuucuggaugugcuccaacggcagccugcagugccggaucugcaucuga

SEQ ID NO: 4905 - RNA, 1701 nt, Artificial Sequence; identical to SEQ ID NO: 4466
  derived and/or modified CDS sequence (AUadapt) from InfluenzaA__ADF87212__HA

SEQ ID NO: 4906 - RNA, 1701 nt, Artificial Sequence; identical to SEQ ID NO: 4629
  derived and/or modified CDS sequence (AUadapt) from InfluenzaA__ADF87232__HA

SEQ ID NO: 4907 - RNA, 1701 nt, Artificial Sequence; identical to SEQ ID NO: 4466
  derived and/or modified CDS sequence (AUadapt) from InfluenzaA__ADF87242__HA

SEQ ID NO: 4908 - RNA, 1701 nt, Artificial Sequence
  derived and/or modified CDS sequence (AUadapt) from InfluenzaA__ADF87252__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaagggcaagucguaccccaagcuguccaagagcuacaucaacgacaaggggaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 4909 - RNA, 1701 nt, Artificial Sequence; identical to SEQ ID NO: 4466
  derived and/or modified CDS sequence (AUadapt) from InfluenzaA__ADF87262__HA

SEQ ID NO: 4910 - RNA, 1701 nt, Artificial Sequence; identical to SEQ ID NO: 4078
  derived and/or modified CDS sequence (AUadapt) from InfluenzaA__ADF87272__HA

SEQ ID NO: 4911 - RNA, 1701 nt, Artificial Sequence; identical to SEQ ID NO: 4078
  derived and/or modified CDS sequence (AUadapt) from InfluenzaA__ADF87282__HA

SEQ ID NO: 4912 - RNA, 1701 nt, Artificial Sequence
  derived and/or modified CDS sequence (AUadapt) from InfluenzaA__ADF87292__HA
augaaggccauccuggugguccuccuguacaccuucgccaccgcgaacgccgacacgcugugcaucggcuaccacgccaacaacucgaccgacaccguggacaccgugcucaagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgggcucgugguccuacaucguggagaccagcuccucggacaacggcacgugcuaccccggggacuucaucgacuacgaggagcuccgggagcagcuguccagcguguccucguucgagcgcuucgagaucuuccccaagaccuccagcuggcccaaccacgacuccaacaagggcgucaccgccgccugcccgcacgccggggccaagucguucuacaagaaccugaucuggcucgugaagaagggcaacuccuaccccaagcugagcaaguccuacaucaacgacaaggggaaggaggugcugguccucuggggcauccaccaccccucgaccagcgccgaccagcagucccuguaccagaacgccgacgccuacguguucgugggcacgucgcgguacuccaagaaguucaagcccgagaucgccauccgcccgaagguccgggaccaggaggggcgcaugaacuacuacuggacccugguggagcccggcgacaagaucaccuucgaggcgaccgggaaccucguggucccccgguacgccuucgccauggagcgcaacgccggcagcggcaucaucaucuccgacacgcccgugcacgacugcaacacgaccugccagaccccgaagggggccaucaacaccucgcugcccuuccagaacauccaccccaucaccaucggcaagugccccaaguacgugaaguccaccaagcugcggcucgcgaccgggcugcgcaacgucccgagcauccagucccggggccuguucggggccaucgccggcuucaucgagggcggguggacgggcaugguggacgggugguacggcuaccaccaccagaacgagcaggggucgggcuacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucggcaacgggugcuucgaguucuaccacaagugcgacaacaugugcauggaguccgugaagaacggcaccuacgacuaccccaaguacagcgaggaggccaagcugaaccgggaggagaucgacggggugaagcucgaguccacgcgcaucuaccagauccuggcgaucuacucgaccgucgccuccagccuggugcucguggucucgcugggcgccaucuccuucuggaugugcagcaacggcucccugcagugccggaucugcaucuga

SEQ ID NO: 4913 - RNA, 1701 nt, Artificial Sequence; identical to SEQ ID NO: 4078
  derived and/or modified CDS sequence (AUadapt) from InfluenzaA__ADF87302__HA

SEQ ID NO: 4914 - RNA, 1701 nt, Artificial Sequence
  derived and/or modified CDS sequence (AUadapt) from InfluenzaA__ADF87331__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccaacagcgacaacggcacgugcuaccccggcgacuucaucaacuacgaggagcuccgggagcagcuguccucgguguccagcuucgagcgcuucgagaucuuccccaagaccuccucguggcccaaccacgacuccaacaaggggaucaccgccgccugcccgcacgccggcgccaagagcuucuacaagaaccugaucuggcucgucaagaaggggaacuccuaccccaagcugucgaaguccuacaucaacgacaagggcaaggaggugcuggugcucugggggauccaccaccccagcaccucggccgaccagcagucccuguaccagaacgccgacgccuacgucuucgugggcagcucccgguacucgaagaaguucaagcccgagaucgccauccgcccgaaggugcgggaccaggagggccgcaugaacuacuacuggacgcuggucgagcccggggacaagaucaccuucgaggcgaccggcaaccucguggugccccgguacgccuucgccauggagcgcaacgccggguccggcaucaucaucagcgacacccccguccacgacugcaacacgaccugccagaccccgaagggcgccaucaacaccucccugcccuuccagaacauccaccccaucacgaucgggaagugccccaaguacgucaagucgaccaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagucgacgcagaacgcgaucgacaagaucaccaacaaggugaacuccgugaucgagaagaugaacacccaguucaccgccgucggcaaggaguucaaccaccuggagaagcgcaucgagaaccugaacaagaagguggacgacggcuuccucgacaucuggacguacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgagccugguccucguggugucccugggggccaucucguucuggaugugcuccaacggcagccugcagugccggaucugcaucuga

SEQ ID NO: 4915 - RNA, 1701 nt, Artificial Sequence; identical to SEQ ID NO: 116
  derived and/or modified CDS sequence (AUadapt) from InfluenzaA__ADF87341__HA

SEQ ID NO: 4916 - RNA, 1701 nt, Artificial Sequence
  derived and/or modified CDS sequence (AUadapt) from InfluenzaA__ADF87351__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgacucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagauguuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 4917 - RNA, 1701 nt, Artificial Sequence; identical to SEQ ID NO: 4541
  derived and/or modified CDS sequence (AUadapt) from InfluenzaA__ADF87361__HA

SEQ ID NO: 4918 - RNA, 1701 nt, Artificial Sequence; identical to SEQ ID NO: 4078
  derived and/or modified CDS sequence (AUadapt) from InfluenzaA__ADF87371__HA

SEQ ID NO: 4919 - RNA, 1701 nt, Artificial Sequence
  derived and/or modified CDS sequence (AUadapt) from InfluenzaA__ADG08115__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccggcaacggcacgugcuaccccggggacuucaucgacuacgaggagcuccgggagcagcugucguccgugagcuccuucgagcgcuucgagaucuuccccaagaccucguccuggcccaaccacgacagcaacaagggcgucaccgccgccugcccgcacgccggggcgaaguccuucuacaagaaccugaucuggcucgugaagaagggcaacucguaccccaagcuguccaagagcuacaucaacgacaaggggaaggaggugcugguccucuggggcauccaccaccccucgaccuccgccgaccagcagagccuguaccagaacgccgacgccuacguguucgugggcacgucccgguacucgaagaaguucaagcccgagaucgccauccgcccgaagguccgggggcaggagggccgcaugaacuacuacuggacccugguggagcccggggacaagaucaccuucgaggcgaccggcaaccucguggucccccgguacgccuucgccauggagcgcaacgccggcuccgggaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggcuucaucgagggcggguggacggggaugguggacggcugguacggguaccaccaccagaacgagcagggcuccggcuacgccgccgaccucaagucgacccagaacgcgaucgacgagaucaccaacaaggugaacuccgucaucgagaagaugaacacccaguucacggccguggggaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggcgccaucucguucuggaugugcuccaacgggagccugcagugccggaucugcaucuga

SEQ ID NO: 4920 - RNA, 1701 nt, Artificial Sequence; identical to SEQ ID NO: 3656
  derived and/or modified CDS sequence (AUadapt) from InfluenzaA__ADG21004__HA

SEQ ID NO: 4921 - RNA, 1701 nt, Artificial Sequence; identical to SEQ ID NO: 3656
  derived and/or modified CDS sequence (AUadapt) from InfluenzaA__ADG21006__HA

SEQ ID NO: 4922 - RNA, 1701 nt, Artificial Sequence
  derived and/or modified CDS sequence (AUadapt) from InfluenzaA__ADG21008__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccagaucgaggugacgaacgccaccgagcugguccagucguccagcaccggggagaucugcgacucgccccaccagauccuggacggcgagaacugcacccucaucgacgcccugcugggggacccccagugcgacggcuuccagaacaagaagugggaccucuucguggagcgcagcaaguccuacucgaacugcuaccccuacgacgugccggacuacgccucccugcggagccuggucgcguccucgggcacgcucgaguucaacaacgaguccuucaacuggaccggggugacccagaacggcaccagcuccgccugcauccgcaagucgaacaacuccuucuucagccggcugaacuggcugacgcaccucaaguucaaguaccccgcccugaacgugaccaugcccaacaacgagcaguucgacaagcuguacaucuggggcguccaccaccccgggaccgacaacgaccagaucuuccucuacgcccaggcguccgggcgcaucaccgugucgacgaagcggagccagcagaccgugaucccgaacaucggcucccgcccccggguccgcaacauccccucgcggaucuccaucuacuggaccaucgugaagcccggcgacauccugcugaucaacagcaccgggaaccucaucgccccgcgcggcuacuucaagauccgguccgggaaguccuccaucaugcgcucggacgcccccaucggcaagugcaacuccgagugcaucacgcccaacggcagcauccccaacgacaagccguuccagaacgugaaccggaucaccuacggggccugcccccgcuacgucaagcagaacacccugaagcuggccaccggcaugcggaacgugcccgagaagcagacgcgcgggaucuucggcgcgaucgccggguucaucgagaacggcugggagggcaugguggacgggugguacggcuuccggcaccagaacuccgaggggcgcggccaggccgccgaccucaagucgacccaggccgcgaucgaccagaucaacgggaagcugaaccggcugaucggcaagaccaacgagaaguuccaccagaucgagaaggaguucuccgaggucgagggccgcauccaggaccucgagaaguacguggaggacaccaagaucgaccuguggagcuacaacgccgagcugcucguggcccuggagaaccagcacacgaucgaccugaccgacuccgagaugaacaagcuguucgagaagaccaagaagcagcuccgggagaacgccgaggacauggggaacggcugcuucaagaucuaccacaagugcgacaacgccugcaucgggucgauccgcaacggcaccuacgaccacgacgucuaccgcgacgaggcgcugaacaaccgguuccagaucaaggggguggagcucaaguccggcuacaaggacuggauccuguggaucagcuucgccaucuccugcuuccugcucugcguggcccugcugggcuucaucaugugggccugccagaaggggaacauccgcugcaacaucugcaucuga

SEQ ID NO: 4923 - RNA, 1701 nt, Artificial Sequence
  derived and/or modified CDS sequence (AUadapt) from InfluenzaA__ADG21009__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcaccuccgguucaaguaccccgcccugaacgugaccaugcccaacaacgagcaguucgacaagcuguacaucuggggcguccaccaccccgggaccgacaacgaccagaucuuccuguacgcgcaggccucggggcgcaucaccguguccacgaagcggagccagcagaccgugaucccgaacaucggcucgcgcccccggguccgcaacauccccucccggaucagcaucuacuggaccaucgugaagcccggcgacauccugcucaucaacuccaccgggaaccugaucgccccgcgcggcuacuucaagauccggucggggaaguccucgaucaugcgcuccgacgcccccaucggcaagugcaacagcgagugcaucacgcccaacggcuccauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggguucaucgagaacggcugggagggcaugguggacgggugguacggcuuccggcaccagaacucggaggggcgcggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgcgagaacgccgaggacauggggaacggcugcuucaagaucuaccacaagugcgacaacgcgugcaucggguccauccggaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 4924 - RNA, 1701 nt, Artificial Sequence; identical to SEQ ID NO: 3656
  derived and/or modified CDS sequence (AUadapt) from InfluenzaA__ADG21010__HA

SEQ ID NO: 4925 - RNA, 1701 nt, Artificial Sequence
  derived and/or modified CDS sequence (AUadapt) from InfluenzaA__ADG21011__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccucggggcggaucaccguguccacgaagcgcagccagcaggccgugaucccgaacaucggcucgcggccccgcguccgggacauccccucccgcaucagcaucuacuggaccaucgugaagcccggcgacauccugcucaucaacuccaccgggaaccugaucgccccgcggggcuacuucaagauccgcucggggaaguccucgaucaugcgguccgacgcccccaucggcaagugcaacagcgagugcaucacccccaacggcuccauccccaacgacaagccguuccagaacgugaaccgcaucacguacggggcgugcccccgguacgucaagcagaacacccugaagcucgccaccggcaugcgcaacgugcccgagaagcagacccgggggaucuucggcgccaucgccggguucaucgagaacggcugggagggcaugguggacgggugguacggcuuccgccaccagaacucggaggggcggggccaggccgcggaccugaaguccacgcaggccgccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacaccaucgaccucacggacucggagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggcgugccagaaggggaacauccggugcaacaucugcaucuga

SEQ ID NO: 4926 - RNA, 1701 nt, Artificial Sequence; identical to SEQ ID NO: 3656
  derived and/or modified CDS sequence (AUadapt) from InfluenzaA__ADG21012__HA

SEQ ID NO: 4927 - RNA, 1701 nt, Artificial Sequence; identical to SEQ ID NO: 3656
  derived and/or modified CDS sequence (AUadapt) from InfluenzaA__ADG21013__HA

SEQ ID NO: 4928 - RNA, 1701 nt, Artificial Sequence
  derived and/or modified CDS sequence (AUadapt) from InfluenzaA__ADG21014__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccagaucgaggugacgaacgccaccgagcugguccagucguccagcaccggggagaucugcgacucgccccaccagauccuggacggcgagaacugcacccucaucgacgcccugcugggggacccccagugcgacggcuuccagaacaagaagugggaccucuucguggagcgcuccaaggccuacuccaacugcuaccccuacgacgugccggacuacgcgagccugcggucccuggucgccucguccggcacgcucgaguucaacaacgagagcuucaacuggaccggggugacccagaacggcaccuccucggccugcauccgccgguccaacaacucguucuucucccgccugaacuggcugacgcaccucaacuucaaguaccccgcccugaacgugaccaugcccaacaacgagcaguucgacaagcuguacaucuggggcguccaccaccccgggaccgacaaggaccagaucuuccucuacgcgcaggccagcgggcggaucaccguguccacgaagcgcucgcagcaggccgugaucccgaacaucggcagccggccccgcguccggaacauccccucccgcaucucgaucuacuggaccaucgugaagcccggcgacauccugcugaucaacuccaccgggaaccucaucgccccgcggggcuacuucaagauccgcagcgggaaguccucgaucaugcgguccgacgcccccaucggcaagugcaacucggagugcaucacccccaacggcuccauccccaacgacaagccguuccagaacgugaaccgcaucacguacggggcgugcccccgguacgucaagcagaacacccugaagcuggccaccggcaugcgcaacgugcccgagaagcagacccgggggaucuucggcgccaucgccggguucaucgagaacggcugggagggcaugguggacgggugguacggcuuccgccaccagaacagcgaggggcggggccaggccgcggaccucaaguccacgcaggccgccaucgaccagaucaacgggaagcugaaccgccugaucggcaagaccaacgagaaguuccaccagaucgagaaggaguucucggaggucgagggccggauccaggaccucgagaaguacguggaggacaccaagaucgaccugugguccuacaacgccgagcugcucguggcccuggagaaccagcacaccaucgaccugacggacagcgagaugaacaagcuguucgagaagaccaagaagcagcuccgcgagaacgcggaggacauggggaacggcugcuucaagaucuaccacaagugcgacaacgccugcaucggguccauccgcaacggcaccuacgaccacgacgucuaccgggacgaggcccugaacaaccgcuuccagaucaaggggguggagcucaagucgggcuacaaggacuggauccuguggaucuccuucgccaucagcugcuuccugcucugcguggcccugcugggcuucaucaugugggcgugccagaaggggaacauccggugcaacaucugcaucuga

SEQ ID NO: 4929 - RNA, 1701 nt, Artificial Sequence
  derived and/or modified CDS sequence (AUadapt) from InfluenzaA__ADG21017__HA
augaagaccaucaucgcccugucguacauccucuaccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucaucgagcgcagcaaggccuacuccaacugcuaccccuacgacgugccggacuacgcgucgcugcggucccucguggccagcuccggcacgcuggaguucaacaacgagucguucaacuggaccggggucacccagaacggcaccuccucggccugcauccgccgguccaacaacagcuucuucucccgccugaacuggcucacgcaccugaacuucaaguaccccgcccugaacgugaccaugcccaacaacgagcaguucgacaagcucuacaucuggggcgugcaccaccccgggaccgacaaggaccagaucuuccuguacgcgcaggccucggggcggaucaccgucuccacgaagcgcagccagcaggccgugaucccgaacaucggcucgcggccccgcgugcggaacauccccucccgcaucagcaucuacuggaccaucgucaagcccggcgacauccugcucaucaacuccaccgggaaccugaucgccccgcggggcuacuucaagauccgcucggggaaguccucgaucaugcgguccgacgcccccaucggcaagugcaacagcgagugcaucacccccaacggcuccauccccaacgacaagccguuccagaacgugaaccgcaucacguacggggcgugcccccgguacgugaagcagaacacccugaagcucgccaccggcaugcgcaacguccccgagaagcagacccgggggaucuucggcgccaucgccggguucaucgagaacggcugggagggcaugguggacgggugguacggcuuccgccaccagaacucggaggggcggggccaggccgcggaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacaccaucgaccucacggacucggagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacguguaccgggacgaggcccucaacaaccgcuuccagaucaagggggucgagcugaaguccggcuacaaggacuggauccuguggaucuccuucgccaucagcugcuuccuccugugcguggcccugcucggcuucaucaugugggcgugccagaaggggaacauccggugcaacaucugcaucuga

SEQ ID NO: 4930 - RNA, 1701 nt, Artificial Sequence
  derived and/or modified CDS sequence (AUadapt) from InfluenzaA__ADG21018__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcacucgaacuucaaguaccccgcccugaacgugaccaugcccaacaacgagcaguucgacaagcuguacaucuggggcguccaccaccccgggaccgacaaggaccagaucuuccucuacgcgcaggccuccgggcggaucaccgugagcacgaagcgcucgcagcaggccgugaucccgaacaucggcucccggcaccgcguccggaacauccccagccgcaucuccaucuacuggaccaucgugaagcccggcgacauccugcugaucaacucgaccgggaaccucaucgcgccccggggcuacuucaagauccgcuccgggaaguccuccaucaugcggucggacgccccgaucggcaagugcaacuccgagugcaucacccccaacggcagcauccccaacgacaagcccuuccagaacgugaaccgcaucacguacggggccugcccgcgguacgucaagcagaacacccugaagcuggccaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgcggaccucaagucgacgcaggccgccaucgaccagaucaacgggaagcugaaccgccugaucggcaagaccaacgagaaguuccaccagaucgagaaggaguucuccgaggucgagggccggauccaggaccucgagaaguacguggaggacaccaagaucgaccuguggagcuacaacgccgagcugcucguggcccuggagaaccagcacaccaucgaccugacggacuccgagaugaacaagcuguucgagaagaccaagaagcagcuccgcgagaacgcggaggacauggggaacggcugcuucaagaucuaccacaagugcgacaacgccugcaucgggucgauccgcaacggcaccuacgaccacgacgucuaccgggacgaggcccugaacaaccgcuuccagaucaaggggguggagcucaaguccggcuacaaggacuggauccuguggaucagcuucgccaucuccugcuuccugcucugcguggcccugcugggcuucaucaugugggcgugccagaaggggaacauccggugcaacaucugcaucuga

SEQ ID NO: 4931 - RNA, 1701 nt, Artificial Sequence
  derived and/or modified CDS sequence (AUadapt) from InfluenzaA__ADG21019__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcgacagcccccaccagauccucgacggcaagaacugcacccugaucgacacgcugcucggggacccccagugcgacggcuuccagaacaagaagugggaccuguucguggagcgcucgaaggccuacuccaacugcuaccccuacgacgugccggacuacgccagccugcggucccucgucgcgucguccggcacccuggaguucaacaacgagagcuucaacuggaccggggugacccagaacggcacguccucggccugcauccgccgguccaagaacagcuucuucucccgccugaacuggcucacccaccugaacuucaaguaccccgcccugaacgugaccaugcccaacaacgagcaguucgacaagcucuacaucuggggcguccaccaccccgggaccgacaaggaccagaucuuccuguacgcccaggcgucggggaagaucaucguguccacgaagcggagccagcagaccgugaucccgaacaucggcucgcgcccccggguccgcaacauccccuccaucaucagcaucuacuggaccaucgugaagcccggcgacauccugcucaucaacuccaccgggaaccugaucgccccgcggggcuacuucaagauccgcucggggaaguccagcaucaugcgguccgacgcccccaucggcaagugcaacucggagugcaucacgcccaacggcuccauccccaacgacaagccguuccagaacgugaaccgcaucaccuacggggccugcccccgguacgucaagcagaacacccugaagcucgccaccggcaugcgcaacgugcccgagaagcagacgcgggggaucuucggcgcgaucgccggguucaucgagaacggcugggagggcaugguggacgggugguacggcuuccgccaccagaacagcgaggggcggggccaggccgccgaccugaaguccacccaggccgcgaucgaccagaucaacgggaagcugaaccgccucaucggcaagaccaacgagaaguuccaccagaucgagaaggaguucucggaggucgagggccggauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacaucgggaacggcugcuucaagaucuaccacaagugcgacaacgccugcaucggguccauccggaacggcaccuacgaccacgacgucuaccgcgacgaggcgcucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 4932 - RNA, 1701 nt, Artificial Sequence
  derived and/or modified CDS sequence (AUadapt) from InfluenzaA__ADG21020__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccaguccggcaccagcuccgccugcauccgccggucgaagaacuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaucgugucgaccaagcgcagccagcagacggugaccccgaacaucggcucccggccccgcguccggaacauccccucgcgcaucuccaucuacuggaccaucgugaagcccggcgacauccugcucaucaacagcaccgggaaccugaucgccccgcggggcuacuucaagauccgcuccgggaaguccuccaucaugcggucggacgcccccaucggcaagugcaacuccgagugcaucacgcccaacggcagcauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggcggggccaggccgccgaccucaagucgacccaggcggccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgcgugcaucgggucgauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 4933 - RNA, 1701 nt, Artificial Sequence; identical to SEQ ID NO: 2679
  derived and/or modified CDS sequence (AUadapt) from InfluenzaA__ADG21022__HA

SEQ ID NO: 4934 - RNA, 1701 nt, Artificial Sequence; identical to SEQ ID NO: 2679
  derived and/or modified CDS sequence (AUadapt) from InfluenzaA__ADG21023__HA

SEQ ID NO: 4935 - RNA, 1701 nt, Artificial Sequence
  derived and/or modified CDS sequence (AUadapt) from InfluenzaA__ADG21024__HA
augaagaccaucaucgcccugucguacauccucugccugguguucacccagaagcugcccggcaacgacaacuccacggccacccucugccuggggcaccacgcggucccgaacggcaccaucgugaagaccaucacgaacgaccagaucgaggugaccaacgccaccgagcugguccagucguccagcaccggggagaucugcgacucgccccaccagauccucgacggcgagaacugcacgcugaucgacgcccugcucggggacccccagugcgacggcuuccagaacaagaagugggaccuguucguggagcgcagcaaggccuacuccaacugcuaccccuacgacgugccggacuacgccucgcugcggucccucgucgcgagcuccggcgcccuggaguucaacaacgagucguucaacuggaccggggugacccagaacggcaccuccagcgccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcaggccgugaucccgaacaucggcagccggccccgcguccggaacauccccucccgcaucucgaucuacuggaccaucgugaagcccggcgacauccugcucaucaacuccaccgggaaccugaucgccccgcggggcuacuucaagauccagagcgggaaguccucgaucaugcgcuccgacgcccccaucggcaagugcaacagcgagugcaucacccccaacggcuccauccccaacgacaagccguuccagaacgugaaccggaucacguacggggcgugcccccgcuacgucaagcagucgacccugaagcucgccaccggcaugcggaacgugcccgagaagcagacccgcgggaucuucggcgccaucgccggguucaucgagaacggcugggagggcaugguggacgggugguacggcuuccggcaccagaacuccgaggggcgcggccaggccgcggaccugaaguccacgcaggccgccaucgaccagaucaacgggaagcugaaccggcucaucggcaagaccaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacaccaucgaccucacggacuccgagaugaacaagcuguucgagaagaccaagaagcagcugcgggagaacgcggaggacauggggaacggcugcuucaagaucuaccacaagugcgacaacgccugcaucgggucgauccgcaacggcaccuacgaccacgacgucuaccgcgacgaggcccucaacaaccgguuccagaucaaggggguggagcugaaguccggcuacaaggacuggauccuguggaucagcuucgccaucuccugcuuccuccugugcguggcccugcucggcuucaucaugugggcgugccagaaggggaacauccgcugcaacaucugcaucuga

SEQ ID NO: 4936 - RNA, 1701 nt, Artificial Sequence
  derived and/or modified CDS sequence (AUadapt) from InfluenzaA__ADG21026__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcgacagcccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccucggggcggaucaccguguccacgaagcgcagccagcaggccgugaucccgaacaucggcucgcggcugcgcguccggaacauccccucccgcaucagcaucuacuggaccaucgugaagcccggcgacauccuccugaucaacuccaccgggaaccugaucgcgccccggggcuacuucaagauccgcucggggaaguccagcaucaugcgguccgacgccccgaucggcaagugcaacucggagugcaucacccccaacggcuccauccccaacgacaagcccuuccagaacgugaaccgcaucacguacggggccugcccgcgguacgucaagcagagcacccucaagcuggccaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgcggaccugaaguccacgcaggccgccaucgaccagaucaacgggaagcucaaccgccugaucggcaagaccaacgagaaguuccaccagaucgagaaggaguucuccgaggucgagggccggauccaggaccuggagaaguacguggaggacaccaagaucgaccucuggucguacaacgccgagcugcugguggcccucgagaaccagcacaccaucgaccugacggacuccgagaugaacaagcuguucgagaagaccaagaagcagcuccgcgagaacgcggaggacauggggaacggcugcuucaccaucuaccacaagugcgacaacgccugcaucgggagcauccgcaacggcaccuacgaccacaacgucuaccgggacgaggcccugaacaaccgcuuccagaucaaggggguggagcugaaguccggcuacaaggacuggauccucuggaucagcuucgccaucuccugcuuccugcugugcguggcccuccugggcuucaucaugugggcgugccagaaggggaacauccggugcaacaucugcaucuga

SEQ ID NO: 4937 - RNA, 1701 nt, Artificial Sequence; identical to SEQ ID NO: 116
  derived and/or modified CDS sequence (AUadapt) from InfluenzaA__ADG21037__HA

SEQ ID NO: 4938 - RNA, 1701 nt, Artificial Sequence
  derived and/or modified CDS sequence (AUadapt) from InfluenzaA__ADG21038__HA
augaaggccauccuggugguccuccuguacaccuucgccaccgcggacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 4939 - RNA, 1701 nt, Artificial Sequence
  derived and/or modified CDS sequence (AUadapt) from InfluenzaA__ADG21040__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacgugcaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggucaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgucaagcucgagagcacccgcguguaccagauccuggcgaucuacuccaccguggccucgagccugguccucguggugucccugggggccaucucguucuggaugugcuccaacggcagccugcagugccggaucugcaucuga

SEQ ID NO: 4940 - RNA, 1701 nt, Artificial Sequence
  derived and/or modified CDS sequence (AUadapt) from InfluenzaA__ADG21041__HA
augaaggccauccuggugguccuccuguacaccuucaccacggccaacgcggacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagacguccucguccgacaacgggaccugcuaccccggcgacuucaucgacuacgaggagcuccgggagcagcugagcuccgugucguccuucgagcgcuucgagaucuuccccaagaccagcuccuggcccaaccacgacucgaacaagggcgucaccgccgccugcccgcacgccggcgccaaguccuucuacaagaaccugaucuggcucgugaagaaggggaacagcuaccccaagcuguccaagucguacaucaacgacaagggcaaggaggugcugguccucugggggauccaccaccccagcacguccgcggaccagcagucgcuguaccagaacgccgacgccuacguguucgugggcaccucccgguacagcaagaaguucaagcccgagaucgccauccgcccgaagguccgggagcaggagggccgcaugaacuacuacuggacccugguggagcccggggacaagaucaccuucgaggccacgggcaaccucguggucccccgguacgcguucgccauggagcgcaacgccggguccggcaucaucaucucggacacccccgugcacgacugcaacacgaccugccagaccccgaagggcgccaucaacaccucccugcccuuccagaacauccacagcaucaccaucgggaagugccccaaguacgugaaguccaccaagcugcggcucgccacgggccugcgcaacguccccucgauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacgagaucaccaacaaggugaacucggucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuacccgaaguacucggaggaggccaagcugaaccgggaggagaucgacggcgugaagcucgaguccacccgcaucuaccagauccuggccaucuacagcaccgucgcgucgucccuggugcucguggucagccugggggccguguccuucuggaugugcagcaacggcucccugcagugccggaucugcaucuga

SEQ ID NO: 4941 - RNA, 1701 nt, Artificial Sequence; identical to SEQ ID NO: 4015
  derived and/or modified CDS sequence (AUadapt) from InfluenzaA__ADG21042__HA

SEQ ID NO: 4942 - RNA, 1701 nt, Artificial Sequence
  derived and/or modified CDS sequence (AUadapt) from InfluenzaA__ADG21043__HA
augaaggccauccuggugguccuccuguacaccuucaccacggccaacgcggacacccugugcgugggcuaccacgccaacaacucgaccgacaccguggacacgguccucgagaagaacgugaccgugacccacuccgucaaccugcuggaggacaagcacaacgggaagcucugcaagcugcgcggcguggcgccccugcaccucgggaagugcaacaucgccggcuggauccuggggaacccggagugcgagagccuguccaccgccucguccuggagcuacaucguggagacguccucguccgacaacgggaccugcuaccccggcgacuucaucgacuacgaggagcuccgggagcagcugagcuccgucucguccuucgagcgcuucgagaucuuccccaagaccagcuccuggcccaaccacgacucgaacaagggcgugaccgccgccugcccgcacgccggcgccaaguccuucuacaagaaccugaucuggcucgugaagaaggggaacagcuaccccaagcuguccaagucguacaucaacgacaagggcaaggagguccuggugcucugggggauccaccaccccagcacguccgcggaccagcagucgcuguaccagaacgccgacgccuacguguucgucggcaccucccgguacagcaagaaguucaagcccgagaucgccauccgcccgaaggugcgggagcaggagggccgcaugaacuacuacuggacccugguggagcccggggacaagaucaccuucgaggccacgggcaaccucgucgugccccgguacgcguucgccauggagcgcaacgccggguccggcaucaucaucucggacacccccgugcacgacugcaacacgaccugccagaccccgaagggcgccaucaacaccucccugcccuuccagaacauccacagcaucaccaucgggaagugccccaaguacgucaaguccaccaagcugcggcucgccacgggccugcgcaacgugcccucgauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacgagaucaccaacaaggucaacucggugaucgagaagaugaacacgcaguucaccgcggucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacuccaacgucaagaaccucuacgagaaggugcgcagccagcugaagaacaacgccaaggagaucgggaacggcugcuucgaguucuaccacaagugcgacaacacgugcauggaguccgugaagaacgggaccuacgacuacccgaaguacucggaggaggccaagcugaaccgggaggagaucgacggcgucaagcucgaguccacccgcaucuaccagauccuggccaucuacagcaccguggcgucgucccuggugcucgucgugagccugggggccaucuccuucuggaugugcagcaacggcucccugcagugccggaucugcaucuga

SEQ ID NO: 4943 - RNA, 1701 nt, Artificial Sequence
  derived and/or modified CDS sequence (AUadapt) from InfluenzaA__ADG21045__HA
augaaggccauccuggugguccuccuguacaccuucaccacggccaacgcggacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagacguccucguccgacaacgggaccugcuaccccggcgacuucaucgacuacgaggagcuccgggagcagcugagcuccgugucguccuucgagcgcuucgagaucuuccccaagaccagcuccuggcccaaccacgacucgaacaagggcgucaccgccgccugcccgcacgccggcgccaaguccuucuacaagaaccugaucuggcucgugaagaaggggaacagcuaccccaagcuguccaagucguacaucaacgacaagggcaaggaggugcugguccucugggggauccaccaccccagcacguccgcggaccagcagucgcuguaccagaacgccgacgccuacguguucgugggcaccucccgguacagcaagaaguucaagcccgagaucgccauccgcccgaagguccgggagcaggagggccgcaugaacuacuacuggacccugguggagcccggggacaagaucaccuucgaggccacgggcaaccucguggucccccgguacgcguucgccauggagcgcaacgccggguccggcaucaucaucucggacacccccgugcacgacugcaacacgaccugccagaccccgaagggcgccaucaacaccucccugcccuuccagaacauccacagcaucaccaucgggaagugccccaaguacgugaaguccaccaagcugcggcucgccacgggccugcgcaacguccccucgauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacgagaucaccaacaaggugaacucggucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuacccgaaguacucggaggaggccaagcugaaccgggaggagaucgacggcgugaagcucgaguccacccgcaucuaccagauccuggccaucuacagcaccgucgcgucgucccuggugcucguggucagccugggggccaucuccuucuggaugugcagcaacggcucccugcagugccggaucugcaucuga

SEQ ID NO: 4944 - RNA, 1701 nt, Artificial Sequence; identical to SEQ ID NO: 4943
  derived and/or modified CDS sequence (AUadapt) from InfluenzaA__ADG21046__HA

SEQ ID NO: 4945 - RNA, 1701 nt, Artificial Sequence; identical to SEQ ID NO: 4078
  derived and/or modified CDS sequence (AUadapt) from InfluenzaA__ADG21048__HA

SEQ ID NO: 4946 - RNA, 1701 nt, Artificial Sequence
  derived and/or modified CDS sequence (AUadapt) from InfluenzaA__ADG21049__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccggaaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccuccaagggcgccaucaacaccagccugccguuccagaacauccaccccaucaccaucgggaagugccccaaguacgugaaguccaccaagcugcggcucgcgaccggccugcgcaacauccccucgauccagucccgggggcuguucggcgccaucgccggguucaucgagggcggcuggacggggauggucgacggcugguacggguaccaccaccagaacgagcagggcagcggguacgccgccgaccucaaguccacccagaacgcgaucgacgagaucaccaacaaggugaacucggugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuacccgaaguacucggaggaggccaagcugaaccgggaggagaucgacggcgugaagcucgaguccacccgcaucuaccagauccuggcgaucuacagcaccguggccucgucccugguccucguggugagccugggggccaucuccuucuggaugugcagcaacggcucccugcagugccggaucugcaucuga

SEQ ID NO: 4947 - RNA, 1701 nt, Artificial Sequence; identical to SEQ ID NO: 3267
  derived and/or modified CDS sequence (AUadapt) from InfluenzaA__ADG21122__HA

SEQ ID NO: 4948 - RNA, 1701 nt, Artificial Sequence; identical to SEQ ID NO: 4078
  derived and/or modified CDS sequence (AUadapt) from InfluenzaA__ADG21123__HA

SEQ ID NO: 4949 - RNA, 1701 nt, Artificial Sequence; identical to SEQ ID NO: 116
  derived and/or modified CDS sequence (AUadapt) from InfluenzaA__ADG21124__HA

SEQ ID NO: 4950 - RNA, 1701 nt, Artificial Sequence
  derived and/or modified CDS sequence (AUadapt) from InfluenzaA__ADG21125__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucaagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 4951 - RNA, 1701 nt, Artificial Sequence; identical to SEQ ID NO: 62
  derived and/or modified CDS sequence (AUadapt) from InfluenzaA__ADG21126__HA

SEQ ID NO: 4952 - RNA, 1701 nt, Artificial Sequence; identical to SEQ ID NO: 62
  derived and/or modified CDS sequence (AUadapt) from InfluenzaA__ADG21127__HA

SEQ ID NO: 4953 - RNA, 1701 nt, Artificial Sequence; identical to SEQ ID NO: 62
  derived and/or modified CDS sequence (AUadapt) from InfluenzaA__ADG21128__HA

SEQ ID NO: 4954 - RNA, 1701 nt, Artificial Sequence; identical to SEQ ID NO: 62
  derived and/or modified CDS sequence (AUadapt) from InfluenzaA__ADG21129__HA

SEQ ID NO: 4955 - RNA, 1701 nt, Artificial Sequence; identical to SEQ ID NO: 116
  derived and/or modified CDS sequence (AUadapt) from InfluenzaA__ADG21130__HA

SEQ ID NO: 4956 - RNA, 1701 nt, Artificial Sequence; identical to SEQ ID NO: 62
  derived and/or modified CDS sequence (AUadapt) from InfluenzaA__ADG21131__HA

SEQ ID NO: 4957 - RNA, 1701 nt, Artificial Sequence; identical to SEQ ID NO: 62
  derived and/or modified CDS sequence (AUadapt) from InfluenzaA__ADG21132__HA

SEQ ID NO: 4958 - RNA, 1701 nt, Artificial Sequence; identical to SEQ ID NO: 62
  derived and/or modified CDS sequence (AUadapt) from InfluenzaA__ADG21133__HA

SEQ ID NO: 4959 - RNA, 1701 nt, Artificial Sequence; identical to SEQ ID NO: 62
  derived and/or modified CDS sequence (AUadapt) from InfluenzaA__ADG21134__HA

SEQ ID NO: 4960 - RNA, 1701 nt, Artificial Sequence; identical to SEQ ID NO: 62
  derived and/or modified CDS sequence (AUadapt) from InfluenzaA__ADG21135__HA

SEQ ID NO: 4961 - RNA, 1701 nt, Artificial Sequence; identical to SEQ ID NO: 62
  derived and/or modified CDS sequence (AUadapt) from InfluenzaA__ADG21136__HA

SEQ ID NO: 4962 - RNA, 1701 nt, Artificial Sequence; identical to SEQ ID NO: 62
  derived and/or modified CDS sequence (AUadapt) from InfluenzaA__ADG21137__HA

SEQ ID NO: 4963 - RNA, 1701 nt, Artificial Sequence; identical to SEQ ID NO: 62
  derived and/or modified CDS sequence (AUadapt) from InfluenzaA__ADG21138__HA

SEQ ID NO: 4964 - RNA, 1701 nt, Artificial Sequence; identical to SEQ ID NO: 62
  derived and/or modified CDS sequence (AUadapt) from InfluenzaA__ADG21139__HA

SEQ ID NO: 4965 - RNA, 1701 nt, Artificial Sequence
  derived and/or modified CDS sequence (AUadapt) from InfluenzaA__ADG21140__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugaugcucugggggauccaccaccccagcaccuccgccgaccagcagucgcuguaccagaacgccgacgccuacgucuucgugggcuccagccgguacuccaagaaguucaagcccgagaucgccauccgcccgaaggugcgggaccaggagggccgcaugaacuacuacuggacgcuggucgagcccggggacaagaucaccuucgaggcgaccggcaaccucguggugccccgguacgccuucgccauggagcgcaacgccgggucgggcaucaucaucuccgacacccccguccacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgugccgucgauccagucccgggggcuguucggcgccaucgccggguucaucgagggcggcuggaccgggauggucgacggcugguacggguaccaccaccagaacgagcagggcagcggguacgccgccgaccucaaguccacgcagaacgcgaucgacgagaucaccaacaaggugaacucggugaucgagaagaugaacacccaguucaccgccgucggcaaggaguucaaccaccuggagaagcgcaucgagaaccugaacaagaagguggacgacggcuuccucgacaucuggacguacaacgccgagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuaccccaaguacucggaggaggccaagcugaaccgggaggagaucgacggcgugaagcucgaguccacccgcaucuaccagauccuggcgaucuacagcaccguggccucgucccugguccucguggugagccugggggccaucuccuucuggaugugcagcaacggcucccugcagugccggaucugcaucuga

SEQ ID NO: 4966 - RNA, 1701 nt, Artificial Sequence; identical to SEQ ID NO: 62
  derived and/or modified CDS sequence (AUadapt) from InfluenzaA__ADG21141__HA

SEQ ID NO: 4967 - RNA, 1701 nt, Artificial Sequence
  derived and/or modified CDS sequence (AUadapt) from InfluenzaA__ADG21142__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgagaaguccuucuacaagaaccugaucuggcucgugaagaaggggaacagcuaccccaagcuguccaagucguacaucaacgacaagggcaaggaggugcugguccucugggggauccaccaccccagcaccuccgcggaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggccaccggcaaccucguggucccccgguacgcguucgccauggagcgcaacgccgggucgggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgccaccggccugcgcaacgucccgucgauccagucccgggggcuguucggcgcgaucgccggguucaucgagggcggcuggaccgggaugguggacggcugguacggguaccaccaccagaacgagcagggcagcggguacgccgccgaccucaaguccacgcagaacgccaucgacgagaucaccaacaaggugaacucggucaucgagaagaugaacacccaguucaccgcggugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggccaucuacagcaccgucgcgucgucccuggugcucguggucagccugggggccaucuccuucuggaugugcagcaacggcucccugcagugccggaucugcaucuga

SEQ ID NO: 4968 - RNA, 1701 nt, Artificial Sequence; identical to SEQ ID NO: 62
  derived and/or modified CDS sequence (AUadapt) from InfluenzaA__ADG21143__HA

SEQ ID NO: 4969 - RNA, 1701 nt, Artificial Sequence; identical to SEQ ID NO: 62
  derived and/or modified CDS sequence (AUadapt) from InfluenzaA__ADG21144__HA

SEQ ID NO: 4970 - RNA, 1701 nt, Artificial Sequence
  derived and/or modified CDS sequence (AUadapt) from InfluenzaA__ADG21145__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacucguaccccaagcuguccaucagcuacaucaacgacaagggcaaggaggugcugguccucugggggauccaccaccccucgaccuccgccgaccagcagagccuguaccagaacgccgacgccuacguguucgugggcuccucgcgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccucgcugcccuuccagaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 4971 - RNA, 1701 nt, Artificial Sequence; identical to SEQ ID NO: 62
  derived and/or modified CDS sequence (AUadapt) from InfluenzaA__ADG21146__HA

SEQ ID NO: 4972 - RNA, 1701 nt, Artificial Sequence; identical to SEQ ID NO: 62
  derived and/or modified CDS sequence (AUadapt) from InfluenzaA__ADG21147__HA

SEQ ID NO: 4973 - RNA, 1701 nt, Artificial Sequence; identical to SEQ ID NO: 116
  derived and/or modified CDS sequence (AUadapt) from InfluenzaA__ADG21148__HA

SEQ ID NO: 4974 - RNA, 1701 nt, Artificial Sequence; identical to SEQ ID NO: 4015
  derived and/or modified CDS sequence (AUadapt) from InfluenzaA__ADG21149__HA

SEQ ID NO: 4975 - RNA, 1701 nt, Artificial Sequence; identical to SEQ ID NO: 4078
  derived and/or modified CDS sequence (AUadapt) from InfluenzaA__ADG21150__HA

SEQ ID NO: 4976 - RNA, 1701 nt, Artificial Sequence; identical to SEQ ID NO: 62
  derived and/or modified CDS sequence (AUadapt) from InfluenzaA__ADG21151__HA

SEQ ID NO: 4977 - RNA, 1701 nt, Artificial Sequence; identical to SEQ ID NO: 62
  derived and/or modified CDS sequence (AUadapt) from InfluenzaA__ADG21152__HA

SEQ ID NO: 4978 - RNA, 1701 nt, Artificial Sequence; identical to SEQ ID NO: 116
  derived and/or modified CDS sequence (AUadapt) from InfluenzaA__ADG21153__HA

SEQ ID NO: 4979 - RNA, 1701 nt, Artificial Sequence; identical to SEQ ID NO: 62
  derived and/or modified CDS sequence (AUadapt) from InfluenzaA__ADG21154__HA

SEQ ID NO: 4980 - RNA, 1701 nt, Artificial Sequence; identical to SEQ ID NO: 62
  derived and/or modified CDS sequence (AUadapt) from InfluenzaA__ADG21155__HA

SEQ ID NO: 4981 - RNA, 1701 nt, Artificial Sequence; identical to SEQ ID NO: 4078
  derived and/or modified CDS sequence (AUadapt) from InfluenzaA__ADG21156__HA

SEQ ID NO: 4982 - RNA, 1701 nt, Artificial Sequence; identical to SEQ ID NO: 4086
  derived and/or modified CDS sequence (AUadapt) from InfluenzaA__ADG21158__HA

SEQ ID NO: 4983 - RNA, 1701 nt, Artificial Sequence
  derived and/or modified CDS sequence (AUadapt) from InfluenzaA__ADG21159__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcuccuggugucccugggggccaucucguucuggaugugcuccaacggcagccuccagugccggaucugcaucuga

SEQ ID NO: 4984 - RNA, 1701 nt, Artificial Sequence; identical to SEQ ID NO: 4086
  derived and/or modified CDS sequence (AUadapt) from InfluenzaA__ADG21160__HA

SEQ ID NO: 4985 - RNA, 1701 nt, Artificial Sequence
  derived and/or modified CDS sequence (AUadapt) from InfluenzaA__ADG21161__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggagaacucguaccccaagcuguccaagagcuacaucaacgacaaggggaaggaggugcugguccucuggggcauccaccaccccucgaccuccgccgaccagcagagccuguaccagaacgccgacgccuacguguucguggggacgucccgguacucgaagaaguucaagcccgagaucgccauccgcccgaagguccgggaccaggagggccgcaugaacuacuacuggacccugguggagcccggcgacaagaucaccuucgaggcgaccgggaaccucguggucccccgguacgccuucgccauggagcgcaacgccggcuccgggaucaucaucagcgacacgcccgugcacgacugcaacacgaccugccagaccccgaagggcgccaucaacaccucccugcccuuccagaacauccaccccaucaccaucggcaagugccccaaguacgucaagucgaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagucgacccagaacgcgaucgacgagaucaccaacaaggugaacuccgucaucgagaagaugaacacccaguucacggccguggggaaggaguucaaccaccuggagaagcgcaucgagaaccugaacaagaaggucgacgacggcuuccucgacaucuggaccuacaacgccgagcugcuggugcuccuggagaacgagcggacccuggacuaccacaacagcaacgugaagaaccucuacgagaagguccgcucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcucgagagcacccgcaucuaccagauccuggcgaucuacuccaccgucgccucgagccuggugcucguggucucccugggcgccaucucguucuggaugugcuccaacgggagccugcagugccggaucugcaucuga

SEQ ID NO: 4986 - RNA, 1701 nt, Artificial Sequence
  derived and/or modified CDS sequence (AUadapt) from InfluenzaA__ADG21163__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacgugcaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggucaacuccgugaucgagaagaugaacacccaguucacggccgucggcaaggaguucaaccaccuggagaagcgcaucgagaaccugaacaagaagguggacgacggcuuccucgacguguggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgagccugguccucguggugucccugggggccaucucguucuggaugugcuccaacggcagccugcagugccggaucugcaucuga

SEQ ID NO: 4987 - RNA, 1701 nt, Artificial Sequence
  derived and/or modified CDS sequence (AUadapt) from InfluenzaA__ADG21165__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcaucgcgccccugcaccucgggaagugcaacaucgccggcuggauccuggggaacccggagugcgagucgcuguccaccgcgagcuccuggucguacaucgucgagaccuccagcuccgacaacggcacgugcuaccccggcgacuucaucgacuacgaggagcuccgggagcagcugucguccgugagcuccuucaagcgcuucgagaucuuccccaagaccaacucguggcccaaccacgacuccaacaagggggugaccgccgccugcccgcacgccggcgccaagagcuucuacaagaaccugaucuggcucgucaagaaggggaacuccuaccccaagcugucgaaguccuacaucaacgacaagggcaaggaggugcuggugcucugggggauccaccaccccagcaccucggccgaccagcagucccuguaccagaacgccgacgccuacgucuucgugggcacgucgaaguacuccaagaaguucaagcccgagaucgccauccggccgaaggugcgcgaccaggagggccggaugaacuacuacuggacccuggucgagcccggggacaagaucaccuucgaggcgaccggcaaccucguggugccccgcuacgccuucgccauggagcggaacgccgggagcggcaucaucaucuccgacacgcccguccacgacugcaacacgaccugccagaccccgaagggcgccaucaacaccucgcugcccuuccagaacauccaccccaucaccaucgggaagugccccaaguacgugaaguccaccaagcugcgccucgcgaccggccugcggaacgugccgagcauccagucccgcgggcuguucggcgccaucgccggguucaucgagggcggcuggacggggauggucgacggcugguacggguaccaccaccagaacgagcagggcucgggguacgccgccgaccucaaguccacccagaacgcgaucgacggcaucaccaacaaggugaacagcgugaucgagaagaugaacacccaguucacggccgucggcaaggaguucaaccaccuggagaagcggaucgagaaccugaacaagaagguggacgacggguuccucgacaucuggaccuacaacgccgagcugcugguccuccuggagaacgagcgcacccuggacuaccacgacuccaacgugaagaaccucuacgagaaggugcggucgcagcugaagaacaacgccaaggagaucggcaacgggugcuucgaguucuaccacaagugcgacaacacgugcauggaguccgucaagaacggcaccuacgacuaccccaaguacagcgaggaggccaagcugaaccgcgaggagaucgacggggugaagcucgaguccacccggaucuaccagauccuggcgaucuacucgaccguggccuccagccugguccucguggugucgcugggcgccaucuccuucuggaugugcagcaacggcucccugcagugccgcaucugcaucuga

SEQ ID NO: 4988 - RNA, 1701 nt, Artificial Sequence; identical to SEQ ID NO: 62
  derived and/or modified CDS sequence (AUadapt) from InfluenzaA__ADG21166__HA

SEQ ID NO: 4989 - RNA, 1701 nt, Artificial Sequence
  derived and/or modified CDS sequence (AUadapt) from InfluenzaA__ADG21168__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacucguaccccaagcuguccaaguucuacaucaacgacaagggcaaggaggugcugguccucugggggauccaccaccccagcaccucggccgaccagcagucccuguaccagaacgccgacgccuacguguucgugggcagcucccgguacucgaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucacgaucgggaagugccccaaguacgucaagucgaccaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgacccgcaucuaccagauccuggcgaucuacuccaccgucgccagcucgcuggugcucguggucucccugggggccaucagcuucuggaugugcuccaacggcagccugcagugccggaucugcaucuga

SEQ ID NO: 4990 - RNA, 1701 nt, Artificial Sequence; identical to SEQ ID NO: 4943
  derived and/or modified CDS sequence (AUadapt) from InfluenzaA__ADG21169__HA

SEQ ID NO: 4991 - RNA, 1701 nt, Artificial Sequence; identical to SEQ ID NO: 62
  derived and/or modified CDS sequence (AUadapt) from InfluenzaA__ADG21170__HA

SEQ ID NO: 4992 - RNA, 1701 nt, Artificial Sequence; identical to SEQ ID NO: 62
  derived and/or modified CDS sequence (AUadapt) from InfluenzaA__ADG21173__HA

SEQ ID NO: 4993 - RNA, 1701 nt, Artificial Sequence; identical to SEQ ID NO: 116
  derived and/or modified CDS sequence (AUadapt) from InfluenzaA__ADG21174__HA

SEQ ID NO: 4994 - RNA, 1701 nt, Artificial Sequence; identical to SEQ ID NO: 116
  derived and/or modified CDS sequence (AUadapt) from InfluenzaA__ADG21175__HA

SEQ ID NO: 4995 - RNA, 1701 nt, Artificial Sequence; identical to SEQ ID NO: 62
  derived and/or modified CDS sequence (AUadapt) from InfluenzaA__ADG21176__HA

SEQ ID NO: 4996 - RNA, 1701 nt, Artificial Sequence; identical to SEQ ID NO: 62
  derived and/or modified CDS sequence (AUadapt) from InfluenzaA__ADG21177__HA

SEQ ID NO: 4997 - RNA, 1701 nt, Artificial Sequence; identical to SEQ ID NO: 62
  derived and/or modified CDS sequence (AUadapt) from InfluenzaA__ADG21178__HA

SEQ ID NO: 4998 - RNA, 1701 nt, Artificial Sequence; identical to SEQ ID NO: 3267
  derived and/or modified CDS sequence (AUadapt) from InfluenzaA__ADG21179__HA

SEQ ID NO: 4999 - RNA, 1701 nt, Artificial Sequence; identical to SEQ ID NO: 62
  derived and/or modified CDS sequence (AUadapt) from InfluenzaA__ADG21180__HA

SEQ ID NO: 5000 - RNA, 1701 nt, Artificial Sequence; identical to SEQ ID NO: 62
  derived and/or modified CDS sequence (AUadapt) from InfluenzaA__ADG21181__HA

SEQ ID NO: 5001 - RNA, 1701 nt, Artificial Sequence; identical to SEQ ID NO: 62
  derived and/or modified CDS sequence (AUadapt) from InfluenzaA__ADG21182__HA

SEQ ID NO: 5002 - RNA, 1701 nt, Artificial Sequence; identical to SEQ ID NO: 62
  derived and/or modified CDS sequence (AUadapt) from InfluenzaA__ADG21183__HA

SEQ ID NO: 5003 - RNA, 1701 nt, Artificial Sequence; identical to SEQ ID NO: 4078
  derived and/or modified CDS sequence (AUadapt) from InfluenzaA__ADG21184__HA

SEQ ID NO: 5004 - RNA, 1701 nt, Artificial Sequence
  derived and/or modified CDS sequence (AUadapt) from InfluenzaA__ADG21185__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccuggugaagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggcggugccccaaguacgucaagucgaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggcgaucuacuccaccgucgccucgagccuggugcucguggucucccugggggccaucucguucuggaugugcuccaacggcagccugcagugccgcaucugcaucuga

SEQ ID NO: 5005 - RNA, 1701 nt, Artificial Sequence; identical to SEQ ID NO: 4260
  derived and/or modified CDS sequence (AUadapt) from InfluenzaA__ADG21188__HA

SEQ ID NO: 5006 - RNA, 1707 nt, Artificial Sequence
  derived and/or modified CDS sequence (AUadapt) from InfluenzaA__ADG21402__HA
auggagaagaucgugcugcuccuggccaucgucucgcuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguuccugaacgugcccgaguggucguacaucguggagaagaucaaccccgccaacgaccugugcuaccccgggaacuucaacgacuacgaggagcucaagcaccuccugucccggaucaaccacuucgagaagauccagaucauccccaagagcuccuggucggaccacgaggccuccagcggcgucuccucggccugcccguaccagggccgcuccagcuucuuccggaacgugguguggcugaucaagaaggacaacgcguaccccaccaucaagcgcuccuacaacaacacgaaccaggaggaccugcugguccucugggggauccaccaccccaacgacgccgccgagcagacccggcuguaccagaacccgaccaccuacaucucggugggcacguccacccugaaccagcgccucgugcccaagaucgccacccggagcaaggucaacgggcaguccggccgcauggaguucuucuggaccauccucaagucgaacgacgcgaucaacuucgagagcaacgggaacuucaucgcccccgagaacgccuacaagaucgugaagaagggcgacuccacgaucaugaaguccgagcuggaguacggcaacugcaacaccaagugccagacccccaucggggccaucaacucgagcaugccguuccacaacauccacccccugaccaucggcgagugccccaaguacgugaaguccaaccggcugauccuggccacggggcuccgcaacucgccccagggcgagcggcgccggaagaagcgcggccuguucggggcgaucgccggcuucaucgagggcggguggcaggggauggucgacggcugguacggcuaccaccacuccaacgagcaggggagcggcuacgccgccgacaaggaguccacccagaaggccaucgacggggugaccaacaaggugaacucgaucaucgacaagaugaacacccaguucgaggcggucggccgggaguucaacaaccuggagcgccggaucgagaaccucaacaagaagauggaggacggguuccuggacguguggacguacaacgccgagcugcucgugcugauggagaacgagcgcacccuggacuuccacgacuccaacgucaagaaccucuacgacaaggugcggcugcagcugcgcgacaacgccaaggagcucggcaacggcugcuucgaguucuaccaccggugcgacaacgagugcauggagagcguccgcaacgggaccuacgacuacccgcaguacuccgaggaggcccgccugaagcgggaggagaucucgggcgugaagcuggaguccaucgggaccuaccagauccucagcaucuacuccacgguggccucgucccuggcgcuggccaucauggucgccggccucuuccuguggaugugcagcaacgggagccugcagugccgcaucugcaucuga

SEQ ID NO: 5007 - RNA, 1704 nt, Artificial Sequence
  derived and/or modified CDS sequence (AUadapt) from InfluenzaA__ADG21414__HA
auggagaagaucgugcugcuccuggccaucgucucgaucgugaaguccgaccagaucugcaucggcuaccacgccaacaacucgaccgagcacguggacaccaucauggagaagaacgucacggugacccacgcgcaggacauccuggagaagacccacaacgggaagcucugcaaccuggacggcgugaagccccugauccuccgcgacugcuccgucgccggguggcugcugggcaacccgaugugcgacgaguuccucaacgugcccgaguggagcuacaucguggagaagaucaaccccgccaacgaccugugcuaccccgggaacuucaacgacuacgaggagcugaagcaccuccugucccggaucaaccacuucgagaagauccagaucaucccgaagaacucgugguccgaccacgaggccagcggcgucuccucggccugccccuaccagggccgcuccagcuucuuccggaacgugguguggcugaccaagaagaacaacgcguaccccacgaucaagaaguccuacaacaacaccaaccaggaggaccuccugguccugugggggauccaccaccccaacgacggcgccgagcagacccgccucuaccagaacccgaccacguacaucucgguggggaccuccacccugaaccagcggcuggugcccaagaucgccacccgcucgaaggucaacggccaguccgggcggauggaguucuucuggacgauccucaagagcaacgacgccaucaacuucgaguccaacggcaacuucaucgcgcccgagaacgccuacaagaucgugaagaagggcgacucgaccaucaugaaguccgagcuggaguacgggaacugcaacaccaagugccagacccccaucggcgccaucaacagcucgaugccguuccacaacauccacccccugacgaucggggagugccccaaguacgugaaguccaaccgccucguccuggccaccggccugcggaacagcccccagggcgagcgccggcgcaagaagcggggccucuucggggccaucgcgggguucaucgagggcggguggcagggcaugguggacggcugguacggguaccaccacuccaacgagcagggcucgggguacgccgccgacaaggaguccacccagaaggccaucgacggcgugaccaacaaggucaacucgaucaucgacaagaugaacacgcaguucgaggccguggggcgcgaguucaacaaccuggagcggcgcaucgagaaccugaacaagaagauggaggacggcuuccucgacguguggaccuacaacgcggagcugcugguccucauggagaacgagcggacccuggacuuccacgacuccaacgugaagaaccuguacgacaagguccgccuccagcugcgggacaacgccaaggagcugggcaacgggugcuucgaguucuaccaccgcugcgacaacgagugcauggagagcgugcggaacggcaccuacgacuacccgcaguacuccgaggaggcccgccucaagcgcgaggagaucucgggggugaagcuggaguccaucggcacguaccagauccugagcaucuacuccaccgucgccucgucccucgcccuggcgaucaugguggccgggcuguuccucuggaugugcagcaacggcucccugcagugccggaucugcaucuga

SEQ ID NO: 5008 - RNA, 1704 nt, Artificial Sequence
  derived and/or modified CDS sequence (AUadapt) from InfluenzaA__ADG21416__HA
auggagaagaucgugcugcuccuggccaucgucucgaucgugaaguccgaccagaucugcaucggcuaccacgccaacaacucgaccgagcaggucgacaccaucauggagaagaacgugacggugacccacgcgcaggacauccuggagaagacccacaacgggaagcucugcaaccuggacggcgugaagccccugauccuccgcgacugcuccgucgccggguggcugcugggcaacccgaugugcgacgaguuccucaacgugcccgaguggagcuacaucguggagaagaucaaccccgccaacgaccugugcuaccccgggaacuucaacgacuacgaggagcugaagcaccuccugucccggaucaaccacuucgagaagauccagaucaucccgaagaacucgugguccgaccacgaggccagcggcgucuccucggccugccccuaccagggccgcuccagcuucuuccggaacgugguguggcugaccaagaagaacaacgcguaccccacgaucaagaaguccuacaacaacaccaaccaggaggaccuccugguccugugggggauccaccaccccaacgacgccgccgagcagaccggccucuaccagaacccgaccacguacaucucgguggggaccuccacccugaaccagcgccuggugcccaagaucgccacccggagcaaggucaacggccaguccgggcgcauggaguucuucuggacgauccucaagucgaacgacgugaucaacuucgaguccaacggcaacuucaucgcgcccgagaacgccuacaagaucgugaagaagggcgacagcaccaucaugaaguccgagcuggaguacgggaacugcaacaccaagugccagacccccaucggcgccaucaacucgagcaugccguuccacaacauccacccccugacgaucggggagugccccaaguacgucaaguccaaccggcucgugcuggccaccggccugcgcaacucgccccagggcgagcggcgccggaagaagcgcggccucuucggggccaucgcgggguucaucgagggcggguggcagggcaugguggacggcugguacggguaccaccacuccaacgagcagggcagcggguacgccgccgacaaggaguccacccagaaggccaucgacggcgucaccaacaaggugaacucgaucaucgacaagaugaacacgcaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcugggcaacgggugcuucgaguucuaccaccggugcgacaacgagugcauggagagcgugcgcaacggcaccuacgacuacccgcaguacuccgaggaggcccggcucaagcgcgaggagaucucgggggucaagcuggaguccaucggcacguaccagauccugagcaucuacuccaccguggccucgucccucgcccuggcgaucaugguggccgggcuguuccucuggaugugcagcaacggcucccugcagugccgcaucugcaucuga

SEQ ID NO: 5009 - RNA, 1704 nt, Artificial Sequence
  derived and/or modified CDS sequence (AUadapt) from InfluenzaA__ADG21420__HA
auggagaagaucgugcugcuccuggccaucgucucgaucgugaaguccgaccagaucugcaucggcuaccacgccaacaacucgaccgagcaggucgacaccaucauggagaagaacgugacggugacccacgcgcaggacauccuggagaagacccacaacgggaagcucugcaaccuggacggcgugaagccccugauccuccgcgacugcuccgucgccggguggcugcugggcaacccgaugugcgacgaguuccucaacgugcccgaguggagcuacaucguggagaagaucaaccccgccaacgaccugugcuaccccgggaacuucaacgacuacgaggagcugaagcaccuccugucccggaucaaccacuucgagaagauccagaucaucccgaagaacucgugguccgaccacgaggccagcggcgucuccucggccugccccuaccagggccgcuccagcuucuuccggaacgugguguggcugaccaagaagaacaacgcguaccccacgaucaagaaguccuacaacaacaccaaccaggaggaccuccugguccugugggggauccaccaccccaacgacgccgccgagcagacccgccucuaccagaacccgaccacguacaucucggugggcaccuccacccugaaccagcggcuggugcccaagaucgccacccgcucgaaggucaacgggcaguccggccggauggaguucuucuggacgauccucaagagcaacgacgcgaucaacuucgaguccaacgggaacuucaucgcccccgagaacgccuacaagaucgugaagaagggcgacucgaccaucaugaaguccgagcuggaguacggcaacugcaacaccaagugccagacccccaucggggccaucaacagcucgaugccguuccacaacauccacccccugacgaucggcgagugccccaaguacgugaaguccaaccgccucguccuggccaccgggcugcggaacagcccccagggcgagcgccggcgcaagaagcggggccucuucggggcgaucgccggcuucaucgagggcggguggcaggggaugguggacggcugguacggcuaccaccacuccaacgagcaggggucgggcuacgccgccgacaaggaguccacccagaaggccaucgacggggugaccaacaaggucaacucgaucaucgacaagaugaacacgcaguucgaggcggugggccgcgaguucaacaaccuggagcggcgcaucgagaaccugaacaagaagauggaggacggguuccucgacguguggaccuacaacgccgagcugcugguccucauggagaacgagcggacccuggacuuccacgacuccaacgugaagaaccuguacgacaagguccgccuccagcugcgggacaacgccaaggagcugggcaacggcugcuucgaguucuaccaccgcugcgacaacgagugcauggagagcgugcggaacgggaccuacgacuacccgcaguacuccgaggaggcccgccucaagcgcgaggagaucucgggcgugaagcuggaguccaucgggacguaccagauccugagcaucuacuccaccgucgccucgucccucgcgcuggccaucaugguggccggccuguuccucuggaugugcagcaacgggucccugcagugccggaucugcaucuga

SEQ ID NO: 5010 - RNA, 1704 nt, Artificial Sequence
  derived and/or modified CDS sequence (AUadapt) from InfluenzaA__ADG21422__HA
auggagaagaucgugcugcuccuggccaucgucucgcuggugaaguccgaccagaucugcaucggcuaccacgccaacaacucgaccgagcaggucgacaccaucauggagaagaacgugacggugacccacgcgcaggacauccucgagaagacccacaacgggaagcugugcaaccuggacggcgugaagccccucauccugcgcgacugcuccgucgccggguggcugcucggcaacccgaugugcgacgaguuccugaacgugcccgaguggagcuacaucguggagaagaucaaccccaccaacgaccugugcuaccccgggaacuucaacgacuacgaggagcucaagcaccuccugucccggaucaaccacuucgagaagauccagaucaucccgaagaacucgugguccgaccacgaggccagcggcgucuccucggccugccccuaccagggccgcuccucguucuuccggaacgugguguggcugacgaagaagaacaacgccuaccccaccaucaagcgcuccuacaacaacaccaaccaggaggaccugcugguccucugggggauccaccaccccaacgacgcggccgagcagacccggcuguaccagaacccgacgaccuacaucagcgugggcaccuccacccugaaccagcgccucgugcccaagaucgccacgcggucgaaggucaacgggcaguccggccgcauggaguucuucuggaccauccucaagagcaacgacgccaucaacuucgaguccaacgggaacuucaucgcgcccgagaacgccuacaagaucgugaagaagggcgacucgaccaucaugaaguccgagcuggaguacggcaacugcaacaccaagugccagacgcccaucggggccaucaacucgagcaugccguuccacaacauccacccccugaccaucggcgagugccccaaguacgugaaguccaaccggcugguccuggccaccgggcuccgcaacucgccccagggcgagcggcgccggaagaagcgcggccuguucggggccaucgcgggcuucaucgagggcggguggcaggggaugguggacggcugguacggcuaccaccacuccaacgagcaggggagcggcuacgccgccgacaaggaguccacccagaaggccaucgacggggugacgaacaaggucaacucgaucaucgacaagaugaacacccaguucgaggccgugggccgggaguucaacaaccuggagcgccggaucgagaaccucaacaagaagauggaggacggguuccuggacguguggaccuacaacgcggagcugcucguccugauggagaacgagcgcacccuggacuuccacgacuccaacgugaagaaccucuacgacaagguccggcugcagcugcgcgacaacgccaaggagcucggcaacggcugcuucgaguucuaccaccggugcgacaacgagugcauggagucggugcgcaacgggacguacgacuacccgcaguacuccgaggaggcccgcagcaagcgggaggagaucuccggcgugaagcuggagucgaucgggaccuaccagauccuguccaucuacagcaccgucgccuccucgcucgcccuggcgaucaugguggccggccuguuccucuggaugugcuccaacgggagccugcagugccgcaucugcaucuga

SEQ ID NO: 5011 - RNA, 1704 nt, Artificial Sequence
  derived and/or modified CDS sequence (AUadapt) from InfluenzaA__ADG21425__HA
auggagaagaucgugcugcuccuggccaucgucucgcuggugaaguccgaccagaucugcaucggcuaccacgccaacaacucgaccgagcaggucgacaccaucauggagaagaacgugacggugacccacgcgcaggacauccucgagaagacccacaacgggaagcugugcaaccuggacggcgugaagccccucauccugcgcgacugcuccgucgccggguggcugcucggcaacccgaugugcgacgaguuccugaacgugcccgaguggagcuacaucguggagaagaucaaccccgccaacgaccugugcuaccccgggaacuucaacgacuacgaggagcucaagcaccuccugucccggaucaaccacuucgagaagauccagaucaucccgaagaacucgugguccgaccacggcgccucgggcgucuccagcgccugccccuaccaggggcgcuccucguucuuccggaacgugguguggcugaccaagaagaacaacgcguaccccacgaucaagaaguccuacaacaacaccaaccaggaggaccugcugguccucuggggcauccaccaccccaacgacgccgaggagcagacccgccuguaccagaacccgaccacguacaucucgguggggaccuccacccugaaccagcggcucgugcccaagaucgccacccgcagcaaggucaacggccaguccgggcggauggaguucuucuggacgauccucaagucgaacgacgccaucaacuucgaguccaacggcaacuucaucgcgcccgagaacgccuacaagaucgugaagaagggcgacagcaccaucaugaaguccgagcuggaguacgacaacugcaacaccaagugccagacccccaucggggccaucaacucgucgaugccguuccacaacauccacccccugacgaucggcgagugccccaaguacgugaaguccaacaagcugguccuggccaccgggcuccgcaacagcccccagggcgagaagcggcgcaagaagcggggccuguucggggccaucgcgggcuucaucgagggcggguggcaggggaugguggacggcugguacggcuaccaccacuccaacgagcaggggucgggcuacgccgccgacaaggaguccacccagaaggccaucgacggggugaccaacaaggucaacucgaucaucgacaagaugaacacgcaguucgaggccgugggccgcgaguucaacgcgcuggagcggcgcaucgagaaccucaacaagaagauggaggacggguuccuggacguguggaccuacaacgccgagcugcucguccugauggagaacgagcggacccuggacuuccacgacuccaacgugaagaaccucuacgacaagguccgccugcagcugcgggacaacgccaaggagcucggcaacggcugcuucgaguucuaccaccgcugcgacaacgagugcauggagagcgugcggaacgggaccuacgacuacccgcaguacuccgaggaggcccgccugaagcgggaggagaucucgggcgugaagcuggaguccaucgggacguaccagauccucucgaucuacuccaccgucgccagcucccuggcgcuggccaucaugguggccggccucucgcuguggaugugcuccaacgggagccugcagugccgcaucugcaucuga

SEQ ID NO: 5012 - RNA, 1704 nt, Artificial Sequence
  derived and/or modified CDS sequence (AUadapt) from InfluenzaA__ADG21429__HA
auggagaagaucgugcugcuccuggccaucgucucgaucgugaaguccgaccagaucugcaucggcuaccacgccaacaacucgaccgagcaggucgacaccaucauggagaagaacgugacggugacccacgcgcaggacauccuggagaagacccacaacgggaagcucugcaaccuggacggcguggagccccugauccuccgcgacugcuccgucgccggguggcugcugggcaacccgaugugcgacgaguuccucaacgugcccgaguggagcuacaucguggagaagaucaaccccgccaacgaccugugcuaccccgggaacuucaacgacuacgaggagcugaagcaccuccugucccggaucaaccacuucgagaagauccagaucaucccgaagaacucgugguccgaccacgaggccagcggcgucuccucggccugccccuaccagggccgcuccagcuucuuccggaacgugguguggcugaccaagaagaacaacgcguaccccacgaucaagaaguccuacaacaacaccaaccaggaggaccuccugguccugugggggauccaccaccccaacgacgccgccgagcagacccgccucuaccagaacccgaccacguacaucucggugggcaccuccacccugaaccagcggcuggugcccaagaucgccacccgcucgaaggucaacgggcaguccggccggauggaguucuucuggacgauccucaagagcaacgacgugaucaacuucgaguccaacgggaacuucaucgcgcccgagaacgccuacaagaucgugaagaagggcgacucgaccaucaugaaguccgagcuggaguacggcaacugcaacaccaagugccagacccccaucggggccaucaacagcucgaugccguuccacaacauccacccccugacgaucggcgagugccccaaguacgucaaguccgaccgccucgugcuggccaccgggcugcggaacagcccccagggcgagcgccggcgcaagaagcggggccucuucggggccaucgcgggcuucaucgagggcggguggcaggggaugguggacggcugguacggcuaccaccacuccaacgagcaggggucgggcuacgccgccgacaaggaguccacccagaaggccaucgacggggucaccaacaaggugaacucgaucaucgacaagaugaacacgcaguucgaggccgugggccgcgaguucaacaaccuggagcggcgcaucgagaaccugaacaagaagauggaggacggguuccucgacgucuggaccuacaacgcggagcugcuggugcucauggagaacgagcggacccuggacuuccacgacuccaacgucaagaaccuguacgacaaggugcgccuccagcugcgggacaacgccaaggagcugggcaacggcugcuucgaguucuaccaccgcugcgacaacgagugcauggagagcgugcggaacgggaccuacgacuacccgcaguacuccgaggaggcccgccucaagcgcgaggagaucucgggcgucaagcuggaguccaucgggacguaccagauccugagcaucuacuccaccguggccucgucccucgcccuggcgaucaugguggccggccugcuccuguggaugugcagcaacgggucccugcagugccggaucugcaucuga

SEQ ID NO: 5013 - RNA, 1704 nt, Artificial Sequence
  derived and/or modified CDS sequence (AUadapt) from InfluenzaA__ADG21437__HA
auggagaagaucgugcugcuccuggccaucgucucgaucgugaaguccgaccagaucugcaucggcuaccacgccaacaacucgaccgagcaggucgacaccaucauggagaagaacgugacggugacccacgcgcaggacauccuggagaagacccacaacgggaagcucugcaaccuggacggcgugaagccccugauccuccgcgacugcuccgucgccggguggcugcugggcaacccgaugugcgacgaguuccucaacgugcccgaguggagcuacaucguggagaagaucaaccccgccaacgaccugugcuaccccgggaacuucaacgacuacgaggagcugaagcaccuccugucccggaucaaccacuucgagaagauccagaucaucccgaagaacucgugguccgaccacgaggccagcggcgucuccucggccugccccuaccagggccgcuccagcuucuuccggaacgugguguggcugacccagaagaacaacgcguaccccacgaucaagaaguccuacaacaacaccaaccaggaggaccuccugguccugugggggauccaccaccccaacgacgccgccgagcagacccgccucuaccagaacccgaccacguacaucucggugggcaccuccacccugaaccagcggcuggugcccaagaucgccacccgcagcaaggucaacgggcaguccggccggauggaguucuucuggacgauccucaagucgaacgacgugaucaacuucgaguccaacgggaacuucaucgcgcccgagaacgccuacaagaucgugaagaagggcgacagcaccaucaugaaguccgagcuggaguacggcaacugcaacaccaagugccagacccccaucggggccaucaacucgagcaugccguuccacaacauccacccccugacgaucggcgagugccccaaguacgucaaguccaaccgccucgugcuggccaccgggcugcggaacucgccccagggcgagcgccggcgcaagaagcggggccucuucggggccaucgcgggcuucaucgagggcggguggcaggggaugguggacggcugguacggcuaccaccacuccaacgagcaggggagcggcuacgccgccgacaaggaguccacccagaaggccaucgacggggucaccaacaaggugaacucgaucaucgacaagaugaacacgcaguucgaggccgugggccgcgaguucaacaaccuggagcggcgcaucgagaaccugaacaagaagauggaggacggguuccucgacgucuggaccuacaacgcggagcugcuggugcucauggagaacgagcggacccuggacuuccacgacuccaacgucaagaaccuguacgacaaggugcgccuccagcugcgggacaacgccaaggagcugggcaacggcugcuucgaguucuaccaccgcugcgacaacgagugcauggagagcgugcggaacgggaccuacgacuacccgcaguacuccgaggaggcccgccucaagcgcgaggagaucucgggcgucaagcuggaguccaucgggacguaccagauccugagcaucuacuccaccguggccucgucccucgcccuggcgaucaugguggccggccuguuccucuggaugugcagcaacgggucccugcagugccggaucugcaucuga

SEQ ID NO: 5014 - RNA, 1704 nt, Artificial Sequence
  derived and/or modified CDS sequence (AUadapt) from InfluenzaA__ADG21439__HA
auggagaagaucgugcugcuccuggccaucgucucgaucgugaaguccgaccagaucugcaucggcuaccacgccaacaacucgaccgagcaggucgacaccaucauggagaagaacgugacggugacccacgcgcaggacauccuggagaagacccacaacgggaagcucugcaaccuggacggcgugaagccccugauccuccgcgacugcuccgucgccggguggcugcugggcaacccgaugugcgacgaguuccucaacgugcccgaguggagcuacaucguggagaagaucaaccccgccaacgaccugugcuaccccgggaacuucaacgacuacgaggagcugaagcaccuccugucccggaucaaccacuucgagaagauccagaucaucccgaagggcucgugguccgaccacgaggccagcggcgucuccucggccugccccuaccaggggcgcuccagcuucuuccggaacgugguguggcugaccaagaagaacaacgcguaccccacgaucaagaaguccuacaacaacaccaaccaggaggaccuccugguccuguggggcauccaccaccccaacgacgccgccgagcagacccgccucuaccagaacccgaccacguacaucucgguggggaccuccacccugaaccagcggcuggugccccagaucgccacccgcucgaaggucaacggccaguccgggcggauggaguucuucuggacgauccucaagagcaacgacgcgaucaacuucgaguccaacggcaacuucaucgcccccgagaacgccuacaagaucgugaagaagggcgacucgaccaucaugaaguccgagcuggaguacgggaacugcaacaccaagugccagacccccaucggcgccaucaacagcucgaugccguuccacaacauccacccccugacgaucggggagugccccaaguacgugaaguccaaccgccucguccuggccaccggccugcggaacagcccccagggcgagcgccggcgcaagaagcggggccucuucggggcgaucgccggguucaucgagggcggguggcagggcaugguggacggcugguacggguaccaccacuccaacgagcagggcucgggguacgccgccgacaaggaguccacccagaaggccaucgacggcgugaccaacaaggucaacucgaucaucgacaagaugaacacgcaguucgaggcgguggggcgcgaguucaacaaccuggagcggcgcaucgagaaccugaacaagaagauggaggacggcuuccucgacguguggaccuacaacgccgagcugcugguccucauggagaacgagcggacccuggacuuccacgacuccaacgugaagaaccuguacgacaagguccgccuccagcugcgggacaacgccaaggagcugggcaacgggugcuucgaguucuaccaccgcugcgacaacgagugcauggagagcgugcggaacggcaccuacgacuacccgcaguacuccgaggaggcccgccucaagcgcgaggagaucucgggggugaagcuggaguccaucggcacguaccagauccugagcaucuacuccaccgucgccucgucccucgcgcuggccaucaugguggccgggcuguuccucuggaugugcagcaacggcucccugcagugccggaucugcaucuga

SEQ ID NO: 5015 - RNA, 1704 nt, Artificial Sequence
  derived and/or modified CDS sequence (AUadapt) from InfluenzaA__ADG21441__HA
auggagaagaucgugcugcuccuggccaucgucucgaucgugaaguccgaccagaucugcaucggcuaccacgccaacaacucgaccgagcaggucgacaccaucauggagaagaacgugacggugacccacgcgcaggacauccuggagaagacccacaacgggaagcucugcaaccuggacggcgugaagccccugauccuccgcgacugcuccgucgccggguggcugcugggcaacccgaugugcgacgaguuccucaacgugcccgaguggagcuacaucguggagaagaucaaccccuccaacgaccugugcuaccccgggaacuucaacgacuacgaggagcugaagcaccuccugucgcggaucaaccacuucgagaagauccagaucaucccgaagaacuccuggagcgaccacgaggccuccggcgucucguccgccugccccuaccagggccgcagcuccuucuuccggaacgugguguggcugaccaagaagaacaacgccuaccccacgaucaagaaguccuacaacaacaccaaccaggaggaccuccugguccugugggggauccaccaccccaacgacgaggcggagcagaccucgcucuaccagaacccgaccacguacaucagcgugggcaccuccacccugaaccagcgccuggugcccaagaucgccacccggucgaaggucaacgggcaguccggccgcauggaguucuucuggacgauccucaagagcaacgacgccaucaacuucgagucgaacgggaacuucaucgcccccgagaacgcguacaagaucgugaagaagggcgacuccaccaucaugaaguccgagcuggaguacggcaacugcaacaccaagugccagacccccaucggggccaucaacagcucgaugccguuccacaacauccacccccugacgaucggcgagugccccaaguacgugaaguccaaccggcucguccuggccaccgggcugcgcaacagcccccagggcgagcggcgccggaagaagcgcggccucuucggggccaucgccggcuucaucgagggcggguggcaggggaugguggacggcugguacggcuaccaccacuccaacgagcaggggucgggcuacgcggccgacaaggaguccacccagaaggccaucgacggggugaccaacaaggucaacagcaucaucgacaagaugaacacgcaguucgaggccgugggccgggaguucaacaaccuggagcgccggaucgagaaccugaacaagaagauggaggacggguuccucgacguguggaccuacaacgccgagcugcugguccucauggagaacgagcgcacccuggacuuccacgacuccaacgugaagaaccuguacgacaagguccggcuccagcugcgcgacaacgcgaaggagcugggcaacggcugcuucgaguucuaccaccggugcgacaacgagugcauggagucggugcgcaacgggaccuacgacuacccgcaguacuccgaggaggcccggcucaagcgcgaggagaucagcggcgugaagcuggaguccaucgggacguaccagauccugucgaucuacuccaccgucgccagcucccucgcccuggccaucaugguggcgggccuguuccucuggaugugcucgaacgggagccugcagugccgcaucugcaucuga

SEQ ID NO: 5016 - RNA, 1704 nt, Artificial Sequence
  derived and/or modified CDS sequence (AUadapt) from InfluenzaA__ADG21443__HA
auggagaagaucgugcugcuccuggccaucgucucgaucgugaaguccgaccagaucugcaucggcuaccacgccaacaacucgaccgagcaggucgacaccaucauggagaagaacgugacggugacccacgcgcaggacauccuggagaagacccacaacgggaagcucugcaaccuggacggcgugaagccccugauccuccgcgacugcuccgucgccggguggcugcugggcaacccgaugugcgacgaguuccucaacgugcccgaguggagcuacaucguggagaagaucaaccccaccaacgaccugugcuaccccgggaacuucaacgacuacgaggagcugaagcaccuccugucccggaucaaccacuucgagaagauccagaucaucccgaagaacucgugguccgaccacgaggccagcggcgucuccucggccugccccuaccagggccgcuccagcuucuuccggaacgugguguggcugacgaagaagaacaacgccuaccccaccaucaagaaguccuacaacaacaccaaccaggaggaccuccugguccugugggggauccaccaccccaacgacgcggccgagcagacccgccucuaccagaacccgacgaccuacaucucggugggcaccuccacccugaaccagcggcuggugcccaagaucgccacgcgcucgaaggucaacgggcaguccggccggauggaguucuucuggaccauccucaagagcaacgacgccaucaacuucgaguccaacgggaacuucaucgcgcccgagaacgccuacaagaucgugaagaagggcgacucgaccaucaugaaguccgagcuggaguacggcaacugcaacaccaagugccagacgcccaucggggccaucaacagcucgaugccguuccacaacauccacccccugaccaucggcgagugccccaaguacgugaaguccaaccgccucguccuggccaccgggcugcggaacagcccccagggcgagcgccggcgcaagaagcggggccucuucggggccaucgcgggcuucaucgagggcggguggcaggggaugguggacggcugguacggcuaccaccacuccaacgagcaggggucgggcuacgccgccgacaaggaguccacccagaaggccaucgacggggugacgaacaaggucaacucgaucaucgacaagaugaacacccaguucgaggccgugggccgcgaguucaacaaccuggagcggcgcaucgagaaccugaacaagaagauggaggacggguuccucgacguguggaccuacaacgcggagcugcugguccucauggagaacgagcggacccuggacuuccacgacuccaacgugaagaaccuguacgacaagguccgccuccagcugcgggacaacgccaaggagcugggcaacggcugcuucgaguucuaccaccgcugcgacaacgagugcauggagagcgugcggaacgggacguacgacuacccgcaguacuccgaggaggcccgccucaagcgcgaggagaucucgggcgugaagcuggaguccaucgggaccuaccagauccugagcaucuacuccaccgucgccucgucccucgcccuggcgaucaugguggccggccuguuccucuggaugugcagcaacgggucccugcagugccggaucugcaucuga

SEQ ID NO: 5017 - RNA, 1704 nt, Artificial Sequence
  derived and/or modified CDS sequence (AUadapt) from InfluenzaA__ADG21445__HA
auggagaagaucgugcugcuccuggccaucgucucgaucgugaaguccgaccagaucugcaucggcuaccacgccaacaacucgaccgagcaggucgacaccaucauggagaagaacgugacggugacccacgcgcaggacauccuggagaagacccacaacgggaagcucugcaaccuggacggcgugaagccccugauccuccgcgacugcuccgucgccggguggcugcugggcaacccgaugugcgacgaguuccucaacgugcccgaguggagcuacaucguggagaagaucaaccccuccaacgaccugugcuaccccgggaacuucaacgacuacgaggagcugaagcaccuccugucgcggaucaaccacuucgagaagauccagaucaucccgaagaacuccuggagcgaccacgaggccuccggcgucucguccgccugccccuaccagggccgcagcuccuucuuccggaacgugguguggcugaccaagaagaacaacgccuaccccacgaucaagaaguccuacaacaacaccaaccaggaggaccuccugguccugugggggauccaccaccccaacgacgaggcggagcagacccgccucuaccagaacccgaccacguacaucuccgugggcaccucgacccugaaccagcggcuggugcccaagaucgccacccgcuccaaggucaacgggcagagcggccggauggaguucuucuggacgauccucaaguccaacgacgccaucaacuucgagucgaacgggaacuucaucgcccccgagaacgcguacaagaucgugaagaagggcgacagcaccaucaugaaguccgagcuggaguacggcaacugcaacaccaagugccagacccccaucggggccaucaacucguccaugccguuccacaacauccacccccugacgaucggcgagugccccaaguacgucaagucgaaccgccucgugcuggccaccgggcugcggaacagcccccagggcgagcgccggcgcaagaagcggggccucuucggggccaucgccggcuucaucgagggcggguggcaggggaugguggacggcugguacggcuaccaccacucgaacgagcagggguccggcuacgcggccgacaaggagagcacccagaaggccaucgacggggugaccaacaaggucaacuccaucaucgacaagaugaacacgcaguucgaggccgugggccgcgaguucaacaaccuggagcggcgcaucgagaaccugaacaagaagauggaggacggguuccucgacguguggaccuacaacgccgagcugcugguccucauggagaacgagcggacccuggacuuccacgacucgaacgugaagaaccuguacgacaagguccgccuccagcugcgggacaacgcgaaggagcugggcaacggcugcuucgaguucuaccaccgcugcgacaacgagugcauggaguccgugcggaacgggaccuacgacuacccgcaguacagcgaggaggcccgccucaagcgcgaggagaucuccggcgugaagcuggagucgaucgggacguaccagauccuguccaucuacagcaccgucgccuccucgcucgcccuggccaucaugguggcgggccuguuccucuggaugugcuccaacgggagccugcagugccggaucugcaucuga

SEQ ID NO: 5018 - RNA, 1701 nt, Artificial Sequence; identical to SEQ ID NO: 3156
  derived and/or modified CDS sequence (AUadapt) from InfluenzaA__ADG21912__HA

SEQ ID NO: 5019 - RNA, 1701 nt, Artificial Sequence; identical to SEQ ID NO: 116
  derived and/or modified CDS sequence (AUadapt) from InfluenzaA__ADG21913__HA

SEQ ID NO: 5020 - RNA, 1701 nt, Artificial Sequence
  derived and/or modified CDS sequence (AUadapt) from InfluenzaA__ADG21914__HA
augaaggccaucaucgugguccugcucuacaccuucgccaccgcgaacgccgacacgcugugcaucggcuaccacgccaacaacucgaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccagcuccgacaacggcacgugcuaccccggcgacuucaucgacuacgaggagcugcgggagcagcucucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcuggugaagaaggggaacucguaccccaagcucuccaagagcuacaucaacgacaagggcaaggaggugcugguccugugggggauccaccaccccucgaccuccgccgaccagcagagccucuaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucgccauggagcgcaacgccggguccggcaucaucaucagcgacacgcccgugcacgacugcaacacgaccugccagaccccgaagggcgccaucaacaccucccuccccuuccagaacauccaccccaucaccaucgggaagugccccaaguacgucaagucgaccaagcugcggcuggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcuggagagcacccgcaucuaccagauccucgcgaucuacuccaccgucgccucgagccuggugcugguggucucccucggggccaucucguucuggaugugcuccaacggcagccugcagugccggaucugcaucuga

SEQ ID NO: 5021 - RNA, 1701 nt, Artificial Sequence
  derived and/or modified CDS sequence (AUadapt) from InfluenzaA__ADG21915__HA
auggaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccucguccuggagcuacaucguggagaccuccucguccgacaacggcacgugcuaccccggcgacuucaucgacuacgaggagcugcgggagcagcucagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcuggugaagaaggggaacagcuaccccaagcucuccaagucguacaucaacgacaagggcaaggaggugcugguccugugggggauccaccaccccagcaccuccgccgaccagcagucgcucuaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccaucgagcgcaacgccgggucgggcaucaucaucuccgacacccccgugcacgacugcaacacgaccugccagaccccgaagggcgccaucaacaccagccuccccuuccacaacauccaccccaucacgaucgggaagugccccaaguacgugaaguccaccaagcugcggcuggcgaccggccuccgcaacgucccgucgauccagucccgggggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacucggucaucgagaagaugaacacccaguucaccgccgugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcuggaguccacccgcaucuaccagauccucgcgaucuacagcaccgucgccucgucccuggugcugguggucagccucggggccaucuccuucuggaugugcagcaacggcucccugcagugccggaucugcaucuga

SEQ ID NO: 5022 - RNA, 1701 nt, Artificial Sequence; identical to SEQ ID NO: 3156
  derived and/or modified CDS sequence (AUadapt) from InfluenzaA__ADG21916__HA

SEQ ID NO: 5023 - RNA, 1701 nt, Artificial Sequence; identical to SEQ ID NO: 116
  derived and/or modified CDS sequence (AUadapt) from InfluenzaA__ADG21917__HA

SEQ ID NO: 5024 - RNA, 1701 nt, Artificial Sequence; identical to SEQ ID NO: 4414
  derived and/or modified CDS sequence (AUadapt) from InfluenzaA__ADG21918__HA

SEQ ID NO: 5025 - RNA, 1701 nt, Artificial Sequence
  derived and/or modified CDS sequence (AUadapt) from InfluenzaA__ADG21919__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucacgccccugcaccucgggaagugcaacaucgccggcuggauccuggggaacccggagugcgagucgcuguccaccgccagcuccuggucguacaucguggagaccuccagcuccgacaacgggaccugcuaccccggcgacuucaucgacuacgaggagcuccgggagcagcugucguccgugagcuccuucgagcgcuucgagaucuuccccaagaccucguccuggcccaaccacgacagcaacaagggcgucaccgcggccugcccgcacgccggcgccaaguccuucuacaagaaccugaucuggcucgugaagaaggggaacucguaccccaagcuguccaagagcuacaucaacgacaagggcaaggaggugcugguccucugggggauccaccaccccucgacguccgcggaccagcagagccuguaccagaacgccgacgccuacguguucgugggcaccucccgguacucgaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacgagaucaccaacaaggugaacuccgucaucgagaagaugaacacgcaguucaccgcggugggcaaggaguucaaccaccuggagaagcgcaucgagaaccugaacaagaagaucgacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggccaucuacuccaccguggcgucgagccugguccucguggugucccugggggccaucucguucuggaugugcuccaacggcagccugcagugccggaucugcaucuga

SEQ ID NO: 5026 - RNA, 1701 nt, Artificial Sequence; identical to SEQ ID NO: 3156
  derived and/or modified CDS sequence (AUadapt) from InfluenzaA__ADG21921__HA

SEQ ID NO: 5027 - RNA, 1701 nt, Artificial Sequence; identical to SEQ ID NO: 116
  derived and/or modified CDS sequence (AUadapt) from InfluenzaA__ADG21922__HA

SEQ ID NO: 5028 - RNA, 1701 nt, Artificial Sequence
  derived and/or modified CDS sequence (AUadapt) from InfluenzaA__ADG21923__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgccaaccugcuggaggacaagcacaacgggaagcucugcaagcugcgcggcguggcgccccugcaccucgggaagugcaacaucgccggcuggauccuggggaacccggagugcgagucgcuguccaccgccagcuccuggucguacaucgucgagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggugaccgccgccugcccgcacgcgggcgccaaguccuucuacaagaaccugaucuggcucgucaagaaggggaacucguaccccaagcuguccaagagcuacaucaacgacaagggcaaggaggugcuggugcucugggggauccaccaccccucgaccuccgccgaccagcagagccuguaccagaacgccgacgccuacgucuucgugggcuccucgaaguacuccaagaaguucaagcccgagaucgcgauccggccgaaggugcgcgaccaggagggccggaugaacuacuacuggacgcuggucgagcccggggacaagaucaccuucgaggccaccggcaaccucguggugccccgcuacgccuucgccauggagcggaacgccgggagcggcaucaucaucuccgacacccccguccacgacugcaacacgaccugccagaccccgaagggcgcgaucaacaccucgcugcccuuccacaacauccaccccaucacgaucgggaagugccccaaguacgugaaguccaccaagcugcgccucgccaccggccugcggaacgugccgagcauccagucccgcgggcuguucggcgccaucgccggguucaucgagggcggcuggaccgggauggucgacggcugguacggguaccaccaccagaacgagcagggcucgggguacgccgcggaccucaaguccacgcagaacgccaucgacgagaucaccaacaaggugaacagcgugaucgagaagaugaacacccaguucaccgccgucggcaaggaguucaaccaccuggagaagcggaucgagaaccugaacaagaagguggacgacggcuuccucgacaucuggacguacaacgccgagcugcugguccuccuggagaacgagcgcacccuggacuaccacgacuccaacgugaagaaccucuacgagaaggugcggucgcagcugaagaacaacgccaaggagaucgggaacggcugcuucgaguucuaccacaagugcgacaacacgugcauggaguccgucaagaacgggaccuacgacuaccccaaguacagcgaggaggcgaagcugaaccgcgaggagaucgacggcgugaagcucgaguccacccggaucuaccagauccuggccaucuacucgaccguggccagcucccugguccucguggugucgcugggggccaucuccuucuggaugugcagcaacggcucccugcagugccgcaucugcaucuga

SEQ ID NO: 5029 - RNA, 1701 nt, Artificial Sequence
  derived and/or modified CDS sequence (AUadapt) from InfluenzaA__ADG21924__HA
auggaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggagaacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccacaacauccaccccaucacgaucgggaagugccccaaguacgugaaguccaccaagcugcggcucgcgaccggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 5030 - RNA, 1701 nt, Artificial Sequence
  derived and/or modified CDS sequence (AUadapt) from InfluenzaA__ADG21925__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcgacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaagaucgacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgagccugguccucguggugucccugggggccaucucguucuggaugugcuccaacggcagccugcagugccggaucugcaucuga

SEQ ID NO: 5031 - RNA, 1701 nt, Artificial Sequence
  derived and/or modified CDS sequence (AUadapt) from InfluenzaA__ADG21926__HA
augaaggccauccuggugguccuccuguacaccuucgccaccgcgaacgccgacacgcugugcaucggcuaccacgccaacaacucgaccgacaccguggacaccauccucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagucgcuguccaccgccagcuccuggucguacaucgucgagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggugaccgccgccugcccgcacgccggcgcgaaguccuucuacaagaaccugaucuggcucgucaagaaggggaacucguaccccaagcuguccaagagcuacaucaacgacaagggcaaggaggugcuggugcucugggggauccaccaccccucgaccuccgccgaccagcagagccuguaccagaacgccgacgccuacgucuucgugggcacgucccgguacucgaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggaaccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgagccugguccucguggugucccugggggccaucucguucuggaugugcuccaacggcagccugcagugccggaucugcaucuga

SEQ ID NO: 5032 - RNA, 1701 nt, Artificial Sequence; identical to SEQ ID NO: 3156
  derived and/or modified CDS sequence (AUadapt) from InfluenzaA__ADG21927__HA

SEQ ID NO: 5033 - RNA, 1701 nt, Artificial Sequence
  derived and/or modified CDS sequence (AUadapt) from InfluenzaA__ADG21928__HA
augaaggccacccuggugguccuccuguacaccuucgccacggcgaacgccgacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagacguccagcuccgacaacgggaccugcuaccccggcgacuucaucgacuacgaggagcuccgggagcagcugucguccgugagcuccuucgagcgcuucgagaucuuccccaagaccucguccuggcccaaccacgacucgaacaagggcgucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcacguccgccgaccagcagucgcuguaccagaacgccgacgccuacguguucgugggcaccucccgguacagcaagaaguucaagcccgagaucgccauccgcccgcggguccgcgaccaggagggccggaugaacuacuacuggacccugguggagcccggggacaagaucaccuucgaggcgacgggcaaccucguggucccccgcuacgccuucgccauggagcgggacgccggguccggcaucaucaucucggacacccccgugcacgacugcaacacgaccugccagaccccgaagggcgccaucaacaccucccugcccuuccagaacauccaccccaucaccaucgggaagugccccaaguacgucaagagcaccaagcugcgccucgcgacgggccugcggaacgugccguccauccagucgcgcgggcuguucggcgccaucgccggguucaucgagggcggcuggaccgggaugguggacggcugguacggguaccaccaccagaacgagcagggcuccggguacgccgccgaccucaagucgacccagaacgcgaucgacgagaucaccaacaaggugaacuccgucaucgagaagaugaacacgcaguucaccgccgugggcaaggaguucaaccaccuggagaagcggaucgagaaccugaacaagaagaucgacgacggcuuccucgacaucuggaccuacaacgccgagcugcugguccuccuggagaacgagcgcacccuggacuaccacgacagcaacgugaagaaccucuacgagaaggugcggucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgcgaggagaucgacggcgugaagcucgagagcacccggaucuaccagauccuggcgaucuacuccaccguggccucgagccugguccucguggugucccugggggccaucucguucuggaugugcuccaacggcagccugcagugccgcaucugcaucuga

SEQ ID NO: 5034 - RNA, 1701 nt, Artificial Sequence; identical to SEQ ID NO: 5030
  derived and/or modified CDS sequence (AUadapt) from InfluenzaA__ADG21930__HA

SEQ ID NO: 5035 - RNA, 1701 nt, Artificial Sequence; identical to SEQ ID NO: 3156
  derived and/or modified CDS sequence (AUadapt) from InfluenzaA__ADG21931__HA

SEQ ID NO: 5036 - RNA, 1701 nt, Artificial Sequence; identical to SEQ ID NO: 3156
  derived and/or modified CDS sequence (AUadapt) from InfluenzaA__ADG21932__HA

SEQ ID NO: 5037 - RNA, 1701 nt, Artificial Sequence; identical to SEQ ID NO: 3156
  derived and/or modified CDS sequence (AUadapt) from InfluenzaA__ADG21933__HA

SEQ ID NO: 5038 - RNA, 1701 nt, Artificial Sequence; identical to SEQ ID NO: 5030
  derived and/or modified CDS sequence (AUadapt) from InfluenzaA__ADG21934__HA

SEQ ID NO: 5039 - RNA, 1701 nt, Artificial Sequence
  derived and/or modified CDS sequence (AUadapt) from InfluenzaA__ADG21935__HA
auggaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggucgggcaucaucaucuccgacacccccgugcacgacugcaacacgaacugccagaccccgaacggcgccaucaacaccagccugcccuuccacaacauccaccccaucaccaucgggaagugccccaaguacgugaaguccacgaagcugcggcucgcgaccggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacccagaacgcgaucgacgagaucacgaacaaggugaacucggucaucgagaagaugaacacccaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 5040 - RNA, 1701 nt, Artificial Sequence; identical to SEQ ID NO: 3156
  derived and/or modified CDS sequence (AUadapt) from InfluenzaA__ADG21936__HA

SEQ ID NO: 5041 - RNA, 1701 nt, Artificial Sequence; identical to SEQ ID NO: 3156
  derived and/or modified CDS sequence (AUadapt) from InfluenzaA__ADG21937__HA

SEQ ID NO: 5042 - RNA, 1701 nt, Artificial Sequence
  derived and/or modified CDS sequence (AUadapt) from InfluenzaA__ADG21938__HA
auggaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccacaacauccaccccaucacgaucgggaagugccccaaguacgugaaguccaccaagcugcggcucgcgaccggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggaaccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 5043 - RNA, 1701 nt, Artificial Sequence; identical to SEQ ID NO: 3156
  derived and/or modified CDS sequence (AUadapt) from InfluenzaA__ADG21939__HA

SEQ ID NO: 5044 - RNA, 1701 nt, Artificial Sequence; identical to SEQ ID NO: 3156
  derived and/or modified CDS sequence (AUadapt) from InfluenzaA__ADG21940__HA

SEQ ID NO: 5045 - RNA, 1701 nt, Artificial Sequence
  derived and/or modified CDS sequence (AUadapt) from InfluenzaA__ADG21941__HA
auggaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccacaacauccaccccaucacgaucgggaagugccccaaguacgugaaguccaccaagcugcggcucgcgaccggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcgcaucgagaaccugaacaagaagaucgacgacggcuuccucgacaucuggacguacaacgccgagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuaccccaaguacucggaggaggccaagcugaaccgggaggagaucgacggcgugaagcucgaguccacccgcaucuaccagauccuggcgaucuacagcaccguggccucgucccugguccucguggugagccugggggccaucuccuucuggaugugcagcaacggcucccugcagugccggaucugcaucuga

SEQ ID NO: 5046 - RNA, 1701 nt, Artificial Sequence
  derived and/or modified CDS sequence (AUadapt) from InfluenzaA__ADG21943__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgaacagcugguccuacaucguggagaccucguccagcgacaacggcacgugcuaccccggcgacuucaucgacuacgaggagcuccgggagcagcuguccucgguguccagcuucgagcgcuucgagaucuuccccaagaccuccucguggcccaaccacgacuccaacaagggggucaccgccgccugcccgcacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacguguucgugggcacgucgcgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcgacgccgggagcggcaucaucaucuccgacacgcccgugcacgacugcaacacgaccugccagaccccgaagggcgccaucaacaccucgcugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcucgggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaagaucgacgacggcuuccucgacaucuggaccuacaacgccgagcugcugguccuccuggagaacgagcggacccuggacuaccacgacuccaacgugaagaaccucuacgagaaggugcgcucgcagcugaagaacaacgccaaggagaucgggaacggcugcuucgaguucuaccacaagugcgacaacacgugcauggaguccgucaagaacgggaccuacgacuaccccaaguacagcgaggaggccaagcugaaccgggaggagaucgacggcgugaagcucgaguccacccgcaucuaccagauccuggcgaucuacucgaccguggccuccagccugguccucguggugucgcugggggccaucuccuucuggaugugcagcaacggcucccugcagugccggaucugcaucuga

SEQ ID NO: 5047 - RNA, 1701 nt, Artificial Sequence
  derived and/or modified CDS sequence (AUadapt) from InfluenzaA__ADG21944__HA
auggaggccauccugaucgugcuccuguacaccuucgccaccgcgaacgccgacacgcugugcaucggcuaccacgccaacaacucgaccgacaccgucgacaccgugcucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagagccuguccaccgccucguccuggagcuacaucgucgagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggugaccgccgccugcccgcacgccggcgcgaaguccuucuacaagaaccugaucuggcucgucaagaaggggaacagcuaccccaagcuguccaagucguacaucaacgacaagggcaaggaggugcuggugcucugggggauccaccaccccagcaccuccgccgaccagcagucgcuguaccagaacgccgacgccuacgucuucgugggcuccagccgguacuccaagaaguucaagcccgagaucgccauccgcccgaaggugcgggaccaggagggccgcaugaacuacuacuggacgcuggucgagcccggggacaagaucaccuucgaggcgaccggcaaccucguggugccccgguacgccuucgccauggagcgcaacgccgggucgggcaucaucaucuccgacacccccguccacgacugcaacacgaccugccagaccccgaagggcgccaucaacaccagccugcccuuccacaacauccaccccaucacgaucgggaagugccccaaguacgugaaguccaccaagcugcggcucgcgaccggccugcgcaacgugccgucgauccagucccgggggcuguucggcgccaucgccggguucaucgagggcggcuggaccgggauggucgacggcugguacggguaccaccaccagaacgagcagggcagcggguacgccgccgaccucaaguccacgcagaacgcgaucgacgagaucaccaacaaggugaacucggugaucgagaagaugaacacccaguucaccgccgucggcaaggaguucaaccaccuggagaagcgcaucgagaaccugaacaagaagguggacgacggcuuccucgacaucuggacguacaacgccgagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuaccccaaguacucggaggaggccaagcugaaccgggaggagaucgacggcgugaagcucgaguccacccgcaucuaccagauccuggcgaucuacagcaccguggccucgucccugguccucguggugagccugggggccaucuccuucuggaugugcagcaacggcucccugcagugccggaucugcaucuga

SEQ ID NO: 5048 - RNA, 1701 nt, Artificial Sequence; identical to SEQ ID NO: 3156
  derived and/or modified CDS sequence (AUadapt) from InfluenzaA__ADG21945__HA

SEQ ID NO: 5049 - RNA, 1701 nt, Artificial Sequence; identical to SEQ ID NO: 3156
  derived and/or modified CDS sequence (AUadapt) from InfluenzaA__ADG21946__HA

SEQ ID NO: 5050 - RNA, 1701 nt, Artificial Sequence; identical to SEQ ID NO: 3156
  derived and/or modified CDS sequence (AUadapt) from InfluenzaA__ADG21947__HA

SEQ ID NO: 5051 - RNA, 1701 nt, Artificial Sequence
  derived and/or modified CDS sequence (AUadapt) from InfluenzaA__ADG21948__HA
auggaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcuccucgcgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccucgcugcccuuccacaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcucgggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggaccaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccagcucccuggugcucguggucucgcugggggccaucuccuucuggaugugcagcaacggcucccugcagugccggaucugcaucuga

SEQ ID NO: 5052 - RNA, 1701 nt, Artificial Sequence
  derived and/or modified CDS sequence (AUadapt) from InfluenzaA__ADG27794__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaccuaccagauccuggcgaucuacuccaccgucgccucgagccuggugcucguggucucccugggggccaucucguucuggaugugcuccaacggcagccugcagugccggaucugcaucuga

SEQ ID NO: 5053 - RNA, 1701 nt, Artificial Sequence; identical to SEQ ID NO: 62
  derived and/or modified CDS sequence (AUadapt) from InfluenzaA__ADG27948__HA

SEQ ID NO: 5054 - RNA, 1701 nt, Artificial Sequence; identical to SEQ ID NO: 62
  derived and/or modified CDS sequence (AUadapt) from InfluenzaA__ADG27966__HA

SEQ ID NO: 5055 - RNA, 1701 nt, Artificial Sequence
  derived and/or modified CDS sequence (AUadapt) from InfluenzaA__ADG27974__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggcgaucuacagcaccgucgccucgucccugauccucguggugagccugggggccaucuccuucuggaugugcagcaacggcucccugcagugccggaucugcaucuga

SEQ ID NO: 5056 - RNA, 1701 nt, Artificial Sequence
  derived and/or modified CDS sequence (AUadapt) from InfluenzaA__ADG27982__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaagcucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 5057 - RNA, 1701 nt, Artificial Sequence; identical to SEQ ID NO: 62
  derived and/or modified CDS sequence (AUadapt) from InfluenzaA__ADG27988__HA

SEQ ID NO: 5058 - RNA, 1701 nt, Artificial Sequence; identical to SEQ ID NO: 62
  derived and/or modified CDS sequence (AUadapt) from InfluenzaA__ADG27997__HA

SEQ ID NO: 5059 - RNA, 1701 nt, Artificial Sequence; identical to SEQ ID NO: 62
  derived and/or modified CDS sequence (AUadapt) from InfluenzaA__ADG28011__HA

SEQ ID NO: 5060 - RNA, 1701 nt, Artificial Sequence; identical to SEQ ID NO: 4466
  derived and/or modified CDS sequence (AUadapt) from InfluenzaA__ADG42093__HA

SEQ ID NO: 5061 - RNA, 1701 nt, Artificial Sequence; identical to SEQ ID NO: 4078
  derived and/or modified CDS sequence (AUadapt) from InfluenzaA__ADG42103__HA

SEQ ID NO: 5062 - RNA, 1701 nt, Artificial Sequence; identical to SEQ ID NO: 3267
  derived and/or modified CDS sequence (AUadapt) from InfluenzaA__ADG42113__HA

SEQ ID NO: 5063 - RNA, 1701 nt, Artificial Sequence; identical to SEQ ID NO: 4466
  derived and/or modified CDS sequence (AUadapt) from InfluenzaA__ADG42123__HA

SEQ ID NO: 5064 - RNA, 1701 nt, Artificial Sequence
  derived and/or modified CDS sequence (AUadapt) from InfluenzaA__ADG42133__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacagcaacaagggggucaccgccgccugcccguacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgugaccggccugcgcaacgugccguccauccagagccgggggcuguucggcgcgaucgccggguucaucgagggcggcuggacggggaugguggacggcugguacggguaccaccaccagaacgagcagggcuccggguacgccgccgaccucaagagcacccagcacgccaucgacgagaucaccaacaaggucaacuccgugaucgagaagaugaacacccaguucacggcggucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacucgaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagucgacccgcaucuaccagauccuggccaucuacuccaccguggcgagcucgcuggugcucgucgugucccugggggccaucagcuucuggaugugcuccaacggcagccugcagugccggaucugcaucuga

SEQ ID NO: 5065 - RNA, 1701 nt, Artificial Sequence
  derived and/or modified CDS sequence (AUadapt) from InfluenzaA__ADG42143__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccagcuccgacaacggcacgugcuaccccggcgacuucaucgacuacgaggagcugcgggagcagcucucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcuggugaagaaggggaacucguaccccaagcucuccaagagcuacaucaacgacaagggcaaggaggugcugguccugugggggauccaccaccccucgaccuccgccgaccagcagagccucuaccagaacgccgacgccuacguguucgugggcuccucgcgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagaagaacgccgggagcggcaucaucaucuccgacacccccgugcacgacugcaacacgaccugccagaccccgaagggcgccaucaacaccucgcuccccuuccagaacauccaccccaucacgaucgggaagugccccaaguacgugaaguccaccaagcugcgccuggcgaccggccuccggaacgucccgagcauccagucccgcgggcuguucggcgccaucgccggguucaucgagggcggcuggaccgggaugguggacggcugguacggguaccaccaccagaacgagcagggcucgggguacgccgccgaccugaaguccacgcagaacgcgaucgacgagaucaccaacaaggugaacagcgucaucgagaagaugaacacccaguucaccgccgugggcaaggaguucaaccaccucgagaagcggaucgagaaccugaacaagaaggucgacgacggcuuccuggacaucuggacguacaacgccgagcuccuggugcugcucgagaacgagcgcacccuggacuaccacgacuccaacgugaagaaccuguacgagaagguccggucgcagcucaagaacaacgccaaggagguggggaacggcugcuucgaguucuaccacaagugcgacaacacgugcauggaguccgugaagaacgggaccuacgacuaccccaaguacagcgaggaggccaagcugaaccgcgaggagaucgacggcgucaagcuggaguccacccggaucuaccagauccucgcgaucuacucgaccgccgccagcucccuggugcugguggucucgcucggggccaucuccuucuggaugugcagcaacggcucccugcagugccgcaucugcaucuga

SEQ ID NO: 5066 - RNA, 1701 nt, Artificial Sequence
  derived and/or modified CDS sequence (AUadapt) from InfluenzaA__ADG42153__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaaggggaucaccgccgccugcccgcacgccggcgcgaaguccuucuacaagaaccugaucuggcucgucaagaaggggaacagcuaccccaagcuguccaagucguacaucaacgacaagggcaaggaggugcuggugcucugggggauccaccaccccagcaccuccgccgaccagcagucgcuguaccagaacgccgacgccuacgucuucgugggcacgucccgguacagcaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucucggacacgcccguccuggacugcaacacgaccugccagaccccgaagggcgccaucaacaccucccugcccuuccagaacauccaccccaucaccaucgggaagugccccaaguacgucaagagcaccaagcuccggcuggcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcgcaucgagaaccucaacaagaagguggacgacggcuuccuggacaucuggaccuacaacgccgagcugcucguccugcuggagaacgagcggacccucgacuaccacgacucgaacgugaagaaccuguacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcucaaccgggaggagaucgacggcgugaagcuggagucgacccgcaucuaccagauccuggcgaucuacuccaccguggccagcucgcucguccugguggugucccugggggccaucagcuucuggaugugcuccaacggcagccuccagugccggaucugcaucuga

SEQ ID NO: 5067 - RNA, 1701 nt, Artificial Sequence; identical to SEQ ID NO: 116
  derived and/or modified CDS sequence (AUadapt) from InfluenzaA__ADG42193__HA

SEQ ID NO: 5068 - RNA, 1701 nt, Artificial Sequence; identical to SEQ ID NO: 116
  derived and/or modified CDS sequence (AUadapt) from InfluenzaA__ADG42213__HA

SEQ ID NO: 5069 - RNA, 1701 nt, Artificial Sequence; identical to SEQ ID NO: 116
  derived and/or modified CDS sequence (AUadapt) from InfluenzaA__ADG42233__HA

SEQ ID NO: 5070 - RNA, 1701 nt, Artificial Sequence
  derived and/or modified CDS sequence (AUadapt) from InfluenzaA__ADG42243__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcuggacugcaacacgaccugccagaccccgaagggcgccaucaacaccucccugcccuuccagaacauccaccccaucaccaucgggaagugccccaaguacgucaagagcaccaagcuccggcuggcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagcacgcgaucgacgagaucaccaacaaggugaacuccgucaucgagaagaugaacacccaguucacggccgugggcaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacucgaacgugaagaaccuguacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcucaaccgggaggagaucgacggcgugaagcuggagucgacccgcaucuaccagauccuggcgaucuacuccaccgucgccagcucgcucgugcugguggucucccugggggccaucagcuucuggaugugcuccaacggcagccuccagugccggaucugcaucuga

SEQ ID NO: 5071 - RNA, 1701 nt, Artificial Sequence; identical to SEQ ID NO: 4334
  derived and/or modified CDS sequence (AUadapt) from InfluenzaA__ADG42253__HA

SEQ ID NO: 5072 - RNA, 1701 nt, Artificial Sequence; identical to SEQ ID NO: 116
  derived and/or modified CDS sequence (AUadapt) from InfluenzaA__ADG42263__HA

SEQ ID NO: 5073 - RNA, 1701 nt, Artificial Sequence; identical to SEQ ID NO: 4015
  derived and/or modified CDS sequence (AUadapt) from InfluenzaA__ADG42273__HA

SEQ ID NO: 5074 - RNA, 1701 nt, Artificial Sequence; identical to SEQ ID NO: 4015
  derived and/or modified CDS sequence (AUadapt) from InfluenzaA__ADG42283__HA

SEQ ID NO: 5075 - RNA, 1701 nt, Artificial Sequence; identical to SEQ ID NO: 4597
  derived and/or modified CDS sequence (AUadapt) from InfluenzaA__ADG42293__HA

SEQ ID NO: 5076 - RNA, 1701 nt, Artificial Sequence
  derived and/or modified CDS sequence (AUadapt) from InfluenzaA__ADG42303__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugaagggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgcgagcagcugucguccgugagcuccuucgagcgguucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgcuacucgaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucgugaucagcgacacgcccgugcacgacugcaacacgaccugccagaccccgaagggcgccaucaacaccucccugcccuuccagaacauccaccccaucaccaucgggaagugccccaaguacgucaagucgaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggucaacuccgugaucgagaagaugaacacccaguucacggccgucggcaaggaguucaaccaccuggagaagcggaucgagaaccugaacaagaagguggacgacggcuuccucgacaucuggaccuacaacgccgagcugcuggugcuccuggagaacgagcgcacccuggacuaccacgacagcaacgucaagaaccucuacgagaaggugcggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgucaagcucgagagcacccggaucuaccagauccuggcgaucuacuccaccguggccucgagccuggugcucgucgugucccugggggccaucucguucuggaugugcuccaacggcagccugcagugccgcaucugcaucuga

SEQ ID NO: 5077 - RNA, 1701 nt, Artificial Sequence; identical to SEQ ID NO: 4624
  derived and/or modified CDS sequence (AUadapt) from InfluenzaA__ADG42313__HA

SEQ ID NO: 5078 - RNA, 1701 nt, Artificial Sequence
  derived and/or modified CDS sequence (AUadapt) from InfluenzaA__ADG42323__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagauguuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagguggggaacggcugcuucgaguucuaccacaagugcgacaacacgugcauggagucggugaagaacgggaccuacgacuaccccaaguacuccgaggaggccaagcugaaccgggaggagaucgacggcgucaagcucgagagcacccgcaucuaccagauccuggcgaucuacuccaccguggccucgagccuggugcucgucgugucccugggggccaucucguucuggaugugcuccaacggcagccugcagugccggaucugcaucuga

SEQ ID NO: 5079 - RNA, 1701 nt, Artificial Sequence
  derived and/or modified CDS sequence (AUadapt) from InfluenzaA__ADG42333__HA
augaaggccauccuggugguccuccuguacacccuggccaccgcgaacgccgacacgcucugcaucggcuaccacgccaacaacucgaccgacaccguggacaccgugcuggagaagaacgucacggugacccacuccgugaaccugcucgaggacaagcacaacgggaagcugugcaagcugcgcggcaucgcgccccuccaccuggggaagugcaacaucgccggcuggauccuggggaacccggagugcgagucgcucuccaccgccagcuccuggucguacaucgucgagaccuccagcuccgacaacggcacgugcuaccccggcgacuucaucgacuacgaggagcugcgggagcagcugucguccgugagcuccuucgagcgcuucgagaucuuccccaagaccucguccuggcccaaccacgacucgaacaagggggugaccgccgccugcccgcacgccggcgcgaaguccuucuacaagaaccucaucuggcuggucaagaaggggaacagcuaccccaagcuguccaagucguacaucaacgacaagggcaaggaggugcucgugcugugggggauccaccaccccagcaccuccgccgaccagcagucgcuguaccagaacgccgacgccuacgucuucgugggcacgucccgguacagcaagaaguucaagcccgagaucgccauccgcccgaaggugcgggaccaggagggccgcaugaacuacuacuggacccucgucgagcccggggacaagaucaccuucgaggcgaccggcaaccugguggugccccgguacgccuucgccauggagcgcaacgccggguccggcaucaucaucucggacgcccccguccacgacugcaacacgaccugccagaccccgaagggcgcgaucaacaccucccugcccuuccagaacauccaccccaucacgaucgggaagugccccaaguacgucaagagcaccaagcuccggcuggccaccggccugcgcaacgugccguccauccagucgcgggggcuguucggcgccaucgccggguucaucgagggcggcuggaccgggaugguggacggcugguacggguaccaccaccagaacgagcagggcuccggguacgccgcggaccucaagucgacgcagaacgccaucgacgagaucaccaacaaggugaacuccgugaucgagaagaugaacacccaguucaccgccgucggcaaggaguucaaccaccuggagaagcgcaucgagaaccucaacaagaagguggacgacggcuuccuggacaucuggacguacaacgccgagcugcucguccugcuggagaacgagcggacccucgacuaccacgacagcaacgugaagaaccuguacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggcgaagcucaaccgggaggagaucgacggcgugaagcuggagagcacccgcaucuaccagauccuggccaucuacuccaccguggccucgagccucguccugguggugucccugggggccaucucguucuggaugugcuccaacggcagccuccagugccggaucugcaucuga

SEQ ID NO: 5080 - RNA, 1701 nt, Artificial Sequence
  derived and/or modified CDS sequence (AUadapt) from InfluenzaA__ADG42343__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggaguccaacgccgggucgggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcgccucgcgaccggccugcggaacgucccgucgauccagucccgcgggcuguucggcgccaucgccggguucaucgagggcggcuggacggggaugguggacggcugguacggguaccaccaccagaacgagcagggcagcggguacgccgccgaccucaaguccacccagcacgcgaucgacgagaucaccaacaaggugaacucggucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgcgaggagaucgacggcgugaagcucgaguccacccggaucuaccagauccuggcgaucuacagcaccgucgccucgucccuggugcucguggucagccugggggccaucuccuucuggaugugcagcaacggcucccugcagugccgcaucugcaucuga

SEQ ID NO: 5081 - RNA, 1701 nt, Artificial Sequence
  derived and/or modified CDS sequence (AUadapt) from InfluenzaA__ADG42363__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcaucgcgccccugcaccucgggaagugcaacaucgccggcuggauccuggggaacccggagugcgagucgcuguccaccgccagcuccuggucguacaucgucgagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggugaccgccgccugcccgcacgccggcgcgaaguccuucuacaagaaccugaucuggcucgucaagaaggggaacucguaccccaagcuguccaagagcuacaucaacgacaagggcaaggaggugcuggugcucugggggauccaccaccccucgaccuccgccgaccagcagagccuguaccagaacgccgacgccuacgucuucgugggcacgucccgguacucgaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgagccugguccucguggugucccugggggccaucucguucuggaugugcuccaacggcagccugcagugccggaucugcaucuga

SEQ ID NO: 5082 - RNA, 1701 nt, Artificial Sequence
  derived and/or modified CDS sequence (AUadapt) from InfluenzaA__ADG42373__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 5083 - RNA, 1701 nt, Artificial Sequence
  derived and/or modified CDS sequence (AUadapt) from InfluenzaA__ADG42393__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgagaagcucugcaagcugcgcggggucgcgccccugcaccucggcaagugcaacaucgccggguggauccugggcaacccggagugcgagucgcuguccaccgccagcuccuggucguacaucguggagaccuccagcuccgacaacgggacgugcuaccccggcgacuucaucgacuacgaggagcuccgggagcagcugucguccgugagcuccuucgagcgcuucgagaucuuccccaagaccucguccuggcccaaccacgacagcaacaagggcgucaccgccgccugcccgcacgccggggcgaaguccuucuacaagaaccugaucuggcucgugaagaagggcaacucguaccccaagcuguccaagagcuacaucaacgacaaggggaaggaggugcugguccucuggggcauccaccaccccucgaccuccgccgaccagcagagccuguaccagaacgccgacgccuacguguucguggggacgucccgguacucgaagaaguucaagcccgagaucgccauccgcccgaagguccgggagcaggagggccgcaugaacuacuacuggacccugguggagcccggcgacaagaucaccuucgaggcgaccgggaaccucguggucccccgguacgccuucgccauggagcgcaacgccggcuccgggaucaucaucagcgacacgcccgugcacgacugcaacacgaccugccagaccccgaagggcgccaucaacaccucccugcccuuccagaacauccaccccaucaccaucggcaagugccccaaguacgucaagucgaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagucgacccagaacgcgaucgacgagaucaccaacaaggugaacuccgucaucgagaagaugaacacccaguucacggccguggggaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcucgagagcacccgcaucuaccagauccuggcgaucuacuccaccgucgccucgagccuggugcuccuggugucccugggcgccaucucguucuggaugugcuccaacgggagccuccagugccggaucugcaucuga

SEQ ID NO: 5084 - RNA, 1701 nt, Artificial Sequence; identical to SEQ ID NO: 4078
  derived and/or modified CDS sequence (AUadapt) from InfluenzaA__ADG42403__HA

SEQ ID NO: 5085 - RNA, 1701 nt, Artificial Sequence; identical to SEQ ID NO: 4334
  derived and/or modified CDS sequence (AUadapt) from InfluenzaA__ADG42413__HA

SEQ ID NO: 5086 - RNA, 1701 nt, Artificial Sequence; identical to SEQ ID NO: 5081
  derived and/or modified CDS sequence (AUadapt) from InfluenzaA__ADG42423__HA

SEQ ID NO: 5087 - RNA, 1701 nt, Artificial Sequence; identical to SEQ ID NO: 4334
  derived and/or modified CDS sequence (AUadapt) from InfluenzaA__ADG42443__HA

SEQ ID NO: 5088 - RNA, 1701 nt, Artificial Sequence
  derived and/or modified CDS sequence (AUadapt) from InfluenzaA__ADG42453__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccagcuccgacaacggcacgugcuaccccggcgacuucaucgacuacgaggagcugcgggagcagcucucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcuggugaagaaggggaacucguaccccaagcucuccaagagcuacaucaacgacaagggcaaggaggugcugguccugugggggauccaccaccccucgaccuccgccgaccagcagagccucuaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucgccauggagcgcaacgccggguccggcaucaucaucagcgacacgcccgugcacgacugcaacacgaccugccagaccccgaagggcgccaucaacaccucccuccccuuccagaacauccaccccaucaccaucgggaagugccccaaguacgucaagucgaccaagcugcggcuggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcgucgagaaccugaacaagaagguggacgacggcuuccuggacaucuggaccuacaacgccgagcuccuggugcugcucgagaacgagcggacccuggacuaccacgacagcaacgucaagaaccuguacgagaaggugcgcucccagcucaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgucaagcuggagagcacccgcaucuaccagauccucgcgaucuacuccaccguggccucgagccuggugcuggucgugucccucggggccaucucguucuggaugugcuccaacggcagccugcagugccggaucugcaucuga

SEQ ID NO: 5089 - RNA, 1701 nt, Artificial Sequence; identical to SEQ ID NO: 3267
  derived and/or modified CDS sequence (AUadapt) from InfluenzaA__ADG42463__HA

SEQ ID NO: 5090 - RNA, 1701 nt, Artificial Sequence; identical to SEQ ID NO: 116
  derived and/or modified CDS sequence (AUadapt) from InfluenzaA__ADG42473__HA

SEQ ID NO: 5091 - RNA, 1701 nt, Artificial Sequence; identical to SEQ ID NO: 4334
  derived and/or modified CDS sequence (AUadapt) from InfluenzaA__ADG42483__HA

SEQ ID NO: 5092 - RNA, 1701 nt, Artificial Sequence; identical to SEQ ID NO: 4466
  derived and/or modified CDS sequence (AUadapt) from InfluenzaA__ADG42493__HA

SEQ ID NO: 5093 - RNA, 1701 nt, Artificial Sequence; identical to SEQ ID NO: 4527
  derived and/or modified CDS sequence (AUadapt) from InfluenzaA__ADG42503__HA

SEQ ID NO: 5094 - RNA, 1701 nt, Artificial Sequence; identical to SEQ ID NO: 4015
  derived and/or modified CDS sequence (AUadapt) from InfluenzaA__ADG42513__HA

SEQ ID NO: 5095 - RNA, 1701 nt, Artificial Sequence
  derived and/or modified CDS sequence (AUadapt) from InfluenzaA__ADG42533__HA
augaaggccauccuggugguccuccuguacaccuucgccaccgcgaaggccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacaucccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgagccugguccucguggugucccugggggccaucucguucuggaugugcuccaacggcagccugcagugccggaucugcaucuga

SEQ ID NO: 5096 - RNA, 1701 nt, Artificial Sequence
  derived and/or modified CDS sequence (AUadapt) from InfluenzaA__ADG42553__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcucccacgccggcgccaagucguucuacaagaaccugaucuggcucgugaagaaggggaacuccuacccgaagcugaacaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgccccaagguccgggagcaggagggccgcaugaacuacuacuggacccugguggagccgggggacaagaucaccuucgaggcgaccggcaaccucguggucccccgguacgccuucgccauggagcgcaacgccggguccggcaucaucaucagcgacacgcccgugcacgacugcaacacgaccugccagacccccaagggcgccaucaacaccucccugccguuccagaacauccaccccaucaccaucgggaagugccccaaguacgucaagucgaccaagcugcggcucgcgaccggccugcgcaacgugcccuccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuacccgaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 5097 - RNA, 1701 nt, Artificial Sequence
  derived and/or modified CDS sequence (AUadapt) from InfluenzaA__ADG42573__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugaucgagcccggggacaagaucaccuucgaggcgaccggcaaccucguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaagcucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgagccugguccucguggugucccugggggccaucucguucuggaugugcuccaacggcagccugcagugccggaucugcaucuga

SEQ ID NO: 5098 - RNA, 1701 nt, Artificial Sequence
  derived and/or modified CDS sequence (AUadapt) from InfluenzaA__ADG42583__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacuccuacguguucgugggcacgagccgguacuccaagaaguucaagcccgagaucgccauccgcccgaagguccgggaccaggagggccgcaugaacuacuacuggacccugguggagcccggggacaagaucaccuucgaggccaccggcaaccucguggucccccgguacgcguucgccauggagcgcaacgccgggucgggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgccaccggccugcgcaacgucccgucgauccagucccgggggcuguucggcgcgaucgccggguucaucgagggcggcuggacggggaugguggacggcugguacggguaccaccaccagaacgagcagggcagcggguacgccgccgaccucaaguccacccagcacgccaucgacgagaucaccaacaaggugaacucggucaucgagaagaugaacacccaguucacggcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggccaucuacagcaccgucgcgucgucccuggugcucguggucagccugggggccaucuccuucuggaugugcagcaacggcucccugcagugccggaucugcaucuga

SEQ ID NO: 5099 - RNA, 1701 nt, Artificial Sequence; identical to SEQ ID NO: 4511
  derived and/or modified CDS sequence (AUadapt) from InfluenzaA__ADG42593__HA

SEQ ID NO: 5100 - RNA, 1701 nt, Artificial Sequence
  derived and/or modified CDS sequence (AUadapt) from InfluenzaA__ADG42603__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggucaccgccgccugcccgcacgccggcgcgaaguccuucuacaagaaccugaucuggcucgugaagaaggggaacagcuaccccaagcugcggaaguccuacaucaacgacaagggcaaggaggugcugguccucugggggauccaccaccccucgaccagcgccgaccagcagucccuguaccagaacgccgacgccuacguguucgugggcacgucgcgcuacuccaagaaguucaagcccgagaucgccacccggccgaagguccgcgaccaggagggccggaugaacuacuacuggacccugguggagcccggggacaagaucaccuucgaggcgacgggcaaccucguggucccccgcuacgccuucgccauggagcggaacgccgggagcggcaucaucaucuccgacacccccgugcacgacugcaacacgaccugccagaccccgaagggcucgaucaacaccucccugcccuuccagaacauccaccccaucaccaucgggaagugccccaaguacgucaagagcaccaagcugcgccucgccacgggccugcggaacgugccguccauccagucgcgcgggcuguucggcgcgaucgccggguucaucgagggcggcuggaccgggaugguggacggcugguacggguaccaccaccagaacgagcagggcuccggguacgccgccgaccucaagucgacccagcacgccaucgacgagaucaccaacaaggugaacuccgucaucgagaagaugaacacgcaguucaccgcggugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggccaucuacuccaccgucgcgucgagccuggugcucguggucucccugggggccaucucguucuggaugugcuccaacggcagccugcagugccgcaucugcaucuga

SEQ ID NO: 5101 - RNA, 1701 nt, Artificial Sequence
  derived and/or modified CDS sequence (AUadapt) from InfluenzaA__ADG42613__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccagcuccgacaacggcacgugcuaccccggcgacuucaucgacuacgaggagcugcgggagcagcucucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcuggugaagaaggggaacucguaccccaagcucuccaagagcuacaucaacgacaagggcaaggaggugcugguccugugggggauccaccaccccucgaccuccgccgaccagcagagccucuaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucgccauggagcgcaacgccggguccggcaucaucaucagcgacacgcccgugcacgacugcaacacgaccugccagaccccgaagggcgccaucaacaccucccuccccuuccagaacauccaccccaucaccaucgggaagugccccaaguacgucaagucgaccaagcugcggcuggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagucggugaagaacgggaccuacgacuaccccaaguacuccgaggaggccaagcugaaccgggagaagaucgacggcgugaagcuggagagcacccgcaucuaccagauccucgcgaucuacuccaccgucgccucgagccuggugcugguggucucccucggggccaucucguucuggaugugcuccaacggcagccugcagugccggaucugcaucuga

SEQ ID NO: 5102 - RNA, 1701 nt, Artificial Sequence; identical to SEQ ID NO: 4541
  derived and/or modified CDS sequence (AUadapt) from InfluenzaA__ADG42623__HA

SEQ ID NO: 5103 - RNA, 1701 nt, Artificial Sequence; identical to SEQ ID NO: 116
  derived and/or modified CDS sequence (AUadapt) from InfluenzaA__ADG42633__HA

SEQ ID NO: 5104 - RNA, 1701 nt, Artificial Sequence
  derived and/or modified CDS sequence (AUadapt) from InfluenzaA__ADG42643__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgccaaccugcuggaggacaagcacaacgggaagcucugcaagcugcgcggcgccgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgucucguccuucgagcgcuucgagauguuccccaagaccagcuccuggcccaaccacgacucgaacaagggggugaccgccgcgugcccgcacgccggcgccaaguccuucuacaagaaccugaucuggcucgugaagaaggggaacagcuaccccaagcuguccaagucguacgucaacgacaagggcaaggaggugcuggugcucugggggauccaccaccccucgaccuccgccgaccagcagagccuguaccagaacgccgacgcguacgucuucgugggcacgucccgguacucgaagaaguucaagcccgagaucgccauccgcccgaaggugcgggaccaggagggccgcaugaacuacuacuggacccuggucgagcccggggacaagaucaccuucgaggccaccggcaaccucguggugccccgguacgccuucgccauggagcgcaacgcgggguccggcaucaucaucagcgacacgcccguccacgacugcaacacgaccugccagaccccgaagggcgccaucaacaccucccugcccuuccagaacauccaccccaucaccaucgggaagugccccaaguacgucaagucgaccaagcugcggcucgccaccggccugcgcaacgugccguccauccagucgcgggggcuguucggcgccaucgccggguucaucgagggcggcuggacggggaugguggacggcugguacggguaccaccaccagaacgagcagggcuccggguacgcggccgaccucaagagcacccagaacgccaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacucgaacgugaagaaccucuacgagaaggugcgcucccagcugaagaacaacgcgaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagucgacccgcaucuaccagauccuggccaucuacuccaccguggccucgagccugguccucguggugucccugggggcgaucucguucuggaugugcuccaacggcagccugcagugccggaucugcaucuga

SEQ ID NO: 5105 - RNA, 1701 nt, Artificial Sequence
  derived and/or modified CDS sequence (AUadapt) from InfluenzaA__ADG42653__HA
augaaggccauccuggugguccuccuguacaccucggccaccgcgaacgccgacacgcugugcaucggcuaccacgccaacaacuccaccgacaccguggacaccgugcucgagaagaacgucacggugacccacucggugaaccugcuggaggacaagcacaacgggaagcucugcaagcugcgcggcgucgcgccccugcaccucgggaagugcaacaucgccggcuggauccuggggaacccggagugcgagucccugagcaccgcguccucgugguccuacaucguggagaccagcuccucggacaacggcacgugcuaccccggcgacuucaucgacuacgaggagcuccgggagcagcuguccagcguguccucguucgagcgcuucgagauguuccccaagaccuccucguggcccaaccacgacuccaacaagggggucaccgccgccugcccgcacgccggcgccaagagcuucuacaagaaccugaucuggcucgugaagaaggggaacuccuaccccaagcugucgaagagcuacaucaacgacaagggcaaggaggugcugguccucugggggauccaccaccccuccaccucggccgaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggucgggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgcgaccggccugcgcaacgucccgucgauccagucccgggggcuguucggcgccaucgccggguucaucgagggcggcuggacggggaugguggacggcugguacggguaccaccaccagaacgagcagggcucgggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccagcucccuggugcucguggucucgcugggggccaucuccuucuggaugugcagcaacggcucccugcagugccggaucugcaucuga

SEQ ID NO: 5106 - RNA, 1701 nt, Artificial Sequence; identical to SEQ ID NO: 4078
  derived and/or modified CDS sequence (AUadapt) from InfluenzaA__ADG42663__HA

SEQ ID NO: 5107 - RNA, 1701 nt, Artificial Sequence
  derived and/or modified CDS sequence (AUadapt) from InfluenzaA__ADG42673__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugaagggcgucgcgccccugcaccucgggaagugcaacaucgccggcuggauccuggggaacccggagugcgagucgcuguccaccgcgggcagcugguccuacaucguggagaccucguccagcgacaacggcacgugcuaccccggggacuucaucgacuacgaggagcuccgcgagcagcuguccucgguguccagcuucgagcgguucgagaucuuccccaagaccuccucguggcccaaccacgacuccaacaagggcgucaccgccgccugcccgcacgccggggccaagagcuucuacaagaaccugaucuggcucgugaagaagggcaacuccuaccccaagcugucgaaguccuacaucaacgacaaggggaaggaggugcugguccucuggggcauccaccaccccagcaccucggccgaccagcagucccuguaccagaacgccgacgccuacguguucgugggcacgucgcgcuacuccaagaaguucaagcccgagaucgccauccggccgaagguccgcgaccaggaggggcggaugaacuacuacuggacccugguggagcccggcgacaagaucaccuucgaggcgaccgggaaccucguggucccccgcuacgccuucgccauggagcggaacgccggcagcggcaucaucaucuccgacacgcccgugcacgacugcaacacgaccugccagaccccgaagggggccaucaacaccucgcugcccuuccagaacauccaccccaucaccaucggcaagugccccaaguacgugaaguccaccaagcugcgccucgcgaccgggcugcggaacgucccgagcauccagucccgcggccuguucggggccaucgccggcuucaucgagggcggguggacgggcaugguggacgggugguacggcuaccaccaccagaacgagcaggggucgggcuacgccgccgaccucaaguccacccagaacgcgaucgacggcaucaccaacaaggugaacagcgucaucgagaagaugaacacccaguucacggccguggggaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaacgugaagaaccucuacgagaagguccggucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgugaagcucgaguccacccggaucuaccagauccuggcgaucuacucgaccgucgccuccagccuggugcucguggucucgcugggcgccaucuccuucuggaugugcagcaacgggucccugcagugccgcaucugcaucuga

SEQ ID NO: 5108 - RNA, 1701 nt, Artificial Sequence
  derived and/or modified CDS sequence (AUadapt) from InfluenzaA__ADG42683__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccagcuccgacaacggcacgugcuaccccggcaacuucaucgacuacgaggagcugcgggagcagcucucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcuggugaagaaggggaacucguaccccaagcucuccaagagcuacaucaacgacaagggcaaggaggugcugguccugugggggauccaccaccccucgaccuccgccgaccagcagagccucuaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucgccauggagcgcaacgccggguccggcaucaucaucagcgacacgcccgugcacgacugcaacacgaccugccagaccccgaagggcgccaucaacaccucccuccccuuccagaacauccaccccaucaccaucgggaagugccccaaguacgucaagucgaccaagcugcggcuggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcuggagagcacccgcaucuaccagauccucgcgaucuacuccaccgucgccucgagccuggugcugguggucucccucggggccaucucguucuggaugugcuccaacggcagccugcagugccggaucugcaucuga

SEQ ID NO: 5109 - RNA, 1701 nt, Artificial Sequence; identical to SEQ ID NO: 4078
  derived and/or modified CDS sequence (AUadapt) from InfluenzaA__ADG42693__HA

SEQ ID NO: 5110 - RNA, 1701 nt, Artificial Sequence; identical to SEQ ID NO: 4786
  derived and/or modified CDS sequence (AUadapt) from InfluenzaA__ADG42703__HA

SEQ ID NO: 5111 - RNA, 1701 nt, Artificial Sequence
  derived and/or modified CDS sequence (AUadapt) from InfluenzaA__ADG42723__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagauggccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 5112 - RNA, 1701 nt, Artificial Sequence; identical to SEQ ID NO: 4541
  derived and/or modified CDS sequence (AUadapt) from InfluenzaA__ADG42743__HA

SEQ ID NO: 5113 - RNA, 1701 nt, Artificial Sequence
  derived and/or modified CDS sequence (AUadapt) from InfluenzaA__ADG42753__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccacggaccagcagucgcuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacuccgggucgggcaucaucaucuccgacacccccgugcacgacugcaacacgaccugccagaccccgaagggcgccaucaacaccagccugcccuuccagaacauccaccccaucaccaucgggaagugccccaaguacgugaaguccaccaagcugcggcucgccacgggccugcgcaacgucccgucgauccagucccgggggcuguucggcgccaucgcgggguucaucgagggcggcuggaccgggaugguggacggcugguacggguaccaccaccagaacgagcagggcagcggguacgccgccgaccucaaguccacccagaacgccaucgacgagaucaccaacaaggugaacucggucaucgagaagaugaacacgcaguucaccgccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggccaucuacagcaccgucgccucgucccuggugcucguggucagccugggggcgaucuccuucuggaugugcagcaacggcucccugcagugccggaucugcaucuga

SEQ ID NO: 5114 - RNA, 1701 nt, Artificial Sequence; identical to SEQ ID NO: 4078
  derived and/or modified CDS sequence (AUadapt) from InfluenzaA__ADG42763__HA

SEQ ID NO: 5115 - RNA, 1701 nt, Artificial Sequence; identical to SEQ ID NO: 4078
  derived and/or modified CDS sequence (AUadapt) from InfluenzaA__ADG42773__HA

SEQ ID NO: 5116 - RNA, 1701 nt, Artificial Sequence
  derived and/or modified CDS sequence (AUadapt) from InfluenzaA__ADG42783__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagauguuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccacggaccagcagagccuguaccagaacgccgacgccuacguguucgugggcaccucccgguacucgaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacaagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggccaucuacuccaccgucgcgucgagccuggugcucguggucucccugggggccaucucguucuggaugugcuccaacggcagccugcagugccggaucugcaucuga

SEQ ID NO: 5117 - RNA, 1701 nt, Artificial Sequence; identical to SEQ ID NO: 4078
  derived and/or modified CDS sequence (AUadapt) from InfluenzaA__ADG42793__HA

SEQ ID NO: 5118 - RNA, 1701 nt, Artificial Sequence; identical to SEQ ID NO: 5116
  derived and/or modified CDS sequence (AUadapt) from InfluenzaA__ADG42803__HA

SEQ ID NO: 5119 - RNA, 1701 nt, Artificial Sequence; identical to SEQ ID NO: 4466
  derived and/or modified CDS sequence (AUadapt) from InfluenzaA__ADG42813__HA

SEQ ID NO: 5120 - RNA, 1701 nt, Artificial Sequence; identical to SEQ ID NO: 4609
  derived and/or modified CDS sequence (AUadapt) from InfluenzaA__ADG42823__HA

SEQ ID NO: 5121 - RNA, 1701 nt, Artificial Sequence; identical to SEQ ID NO: 4511
  derived and/or modified CDS sequence (AUadapt) from InfluenzaA__ADG42833__HA

SEQ ID NO: 5122 - RNA, 1701 nt, Artificial Sequence; identical to SEQ ID NO: 4078
  derived and/or modified CDS sequence (AUadapt) from InfluenzaA__ADG42843__HA

SEQ ID NO: 5123 - RNA, 1701 nt, Artificial Sequence; identical to SEQ ID NO: 4078
  derived and/or modified CDS sequence (AUadapt) from InfluenzaA__ADG42853__HA

SEQ ID NO: 5124 - RNA, 1701 nt, Artificial Sequence; identical to SEQ ID NO: 4632
  derived and/or modified CDS sequence (AUadapt) from InfluenzaA__ADG42863__HA

SEQ ID NO: 5125 - RNA, 1701 nt, Artificial Sequence; identical to SEQ ID NO: 4652
  derived and/or modified CDS sequence (AUadapt) from InfluenzaA__ADG42883__HA

SEQ ID NO: 5126 - RNA, 1701 nt, Artificial Sequence
  derived and/or modified CDS sequence (AUadapt) from InfluenzaA__ADG42893__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaaccugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 5127 - RNA, 1701 nt, Artificial Sequence; identical to SEQ ID NO: 116
  derived and/or modified CDS sequence (AUadapt) from InfluenzaA__ADG42903__HA

SEQ ID NO: 5128 - RNA, 1701 nt, Artificial Sequence; identical to SEQ ID NO: 4078
  derived and/or modified CDS sequence (AUadapt) from InfluenzaA__ADG42913__HA

SEQ ID NO: 5129 - RNA, 1701 nt, Artificial Sequence; identical to SEQ ID NO: 4642
  derived and/or modified CDS sequence (AUadapt) from InfluenzaA__ADG42923__HA

SEQ ID NO: 5130 - RNA, 1701 nt, Artificial Sequence
  derived and/or modified CDS sequence (AUadapt) from InfluenzaA__ADG57087__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgacccgcaucuaccagauccuggcgaucuacuccaccgucgccaucagccuggugcucguggucucgcugggggccaucuccuucuggaugugcagcaacggcucccugcggugccgcaucugcaucuga

SEQ ID NO: 5131 - RNA, 1701 nt, Artificial Sequence; identical to SEQ ID NO: 116
  derived and/or modified CDS sequence (AUadapt) from InfluenzaA__ADG57088__HA

SEQ ID NO: 5132 - RNA, 1701 nt, Artificial Sequence
  derived and/or modified CDS sequence (AUadapt) from InfluenzaA__ADG57089__HA
auggaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucauccaguacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccacaacauccaccccaucacgaucgggaagugccccaaguacgugaaguccaccaagcugcggcucgcgaccggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccgaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 5133 - RNA, 1701 nt, Artificial Sequence
  derived and/or modified CDS sequence (AUadapt) from InfluenzaA__ADG57090__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagcaucuaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucgccauggagcgcaacgccggguccggcaucaucaucagcgacacgcccgugcacgacugcaacacgaccugccagaccccgaagggcgccaucaacaccucccuccccuuccagaacauccaccccaucaccaucgggaagugccccaaguacgucaagucgaccaagcugcggcuggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccuggacaucuggaccuacaacgcccagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcuggagagcacccgcaucuaccagauccucgcgaucuacuccaccgucgccucgagccuggugcugguggucucccucggggccaucucguucuggaugugcuccaacggcagccugcagugccggaucugcaucuga

SEQ ID NO: 5134 - RNA, 1701 nt, Artificial Sequence
  derived and/or modified CDS sequence (AUadapt) from InfluenzaA__ADG57091__HA
auggaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccacaacauccaccccaucacgaucgggaagugccccaaguacgugaaguccaccaagcugcggcucgcgaccggccugcgcaacgucccgucgauccagucccgggggcuguucggcgccaucgccggguucaucgagcgcggcuggaccggcaugguggacgggugguacggcuaccaccaccagaacgagcaggggagcggcuacgccgccgaccucaaguccacgcagaacgcgaucgacgagaucaccaacaaggugaacucggucaucgagaagaugaacacccaguucaccgccguggggaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucggcaacgggugcuucgaguucuaccacaagugcgacaacacgugcauggaguccgugaagaacggcaccuacgacuaccccaaguacucggaggaggccaagcugaaccgcgaggagaucgacggggugaagcucgaguccacccggaucuaccagauccuggcgaucuacagcaccgucgccucgucccuggugcucguggucagccugggcgccaucuccuucuggaugugcagcaacgggucccugcagugccgcaucugcaucuga

SEQ ID NO: 5135 - RNA, 1701 nt, Artificial Sequence
  derived and/or modified CDS sequence (AUadapt) from InfluenzaA__ADG57092__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcugaucaaguccuacaucaacgacaagggcaaggaggugcugguccucugggggauccaccaccccucgaccagcgccgaccagcagucccuguaccagaacgccgacgccuacguguucgugggcacgucgcgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccucgcugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcucgggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 5136 - RNA, 1701 nt, Artificial Sequence
  derived and/or modified CDS sequence (AUadapt) from InfluenzaA__ADG57093__HA
auggaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggagauccuggugcucugggggauccaccaccccucgaccuccgccgaccagcagagccuguaccagaacgccgacgccuacgucuucgugugguccucgcgguacuccaagaaguucaagcccgagaucgccauccgcccgaaggugcgggaccaggagggccgcaugaacuacuacuggacgcuggucgagcccggcgacaagaucaccuucgaggcgaccgggaaccuccuggugccccgguacgccuucgccauggagcgcaacgccggcagcgggaucaucaucuccgacacccccgugcacgacugcaacacgaccugccagaccccgaagggcgccaucaacaccucgcugcccuuccacaacauccaccccaucacgaucggcaagugccccaaguacgucaaguccaccaagcuccggcuggcgaccgggcugcgcaacgugccgagcauccagucccggggccucuucggggccaucgccggcuucaucgagggcggguggaccggcaugguggacgggugguacggcuaccaccaccagaacgagcaggggagcggcuacgccgccgaccugaaguccacgcagaacgcgaucgacgagaucaccaacaaggucaacucggugaucgagaagaugaacacccaguucaccgccguggggaaggaguucaaccaccuggagaagcgcaucgagaaccucaacaagaaggucgacgacggcuuccuggacaucuggacguacaacgccgagcugcucgugcugcuggagaacgagcggacccucgacuaccacgacuccaacgucaagaaccuguacgagaaggugcgcagccagcugaagaacaacgccaaggagaucggcaacgggugcuucgaguucuaccacaagugcgacaacacgugcauggaguccgugaagaacggcaccuacgacuaccccaaguacucggaggaggccaagcucaaccgggaggagaucgacggggucaagcuggaguccacccgcaucuaccagauccuggcgaucuacagcaccguggccucgucccucgugcuggucgugagccugggcgccaucuccuucuggaugugcagcaacgggucccuccagugccggaucugcaucuga

SEQ ID NO: 5137 - RNA, 1701 nt, Artificial Sequence
  derived and/or modified CDS sequence (AUadapt) from InfluenzaA__ADG57094__HA
augaaggccauccuggugguccuccuguacaccuucgccaccgcgaacgccgacacgcugugcgugggcuaccacgccaacaacucgaccgacaccguggacaccguccucgagaagaacgugacggugacccacuccgucaaccugcuggaggacaagcacaacgggaagcucugcaagcugcgcggcguggcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgucagcuccuucgagcgcuucgagaucuuccccaagaccucguccuggcccaaccacgacagcaacaagggggugaccgccgccugcccgcacgccggcgcgaaguccuucuacaagaaccugaucuggcucgugaagaaggggaacucguaccccaagcuguccaagagcuacaucaacgacaagggcaaggagguccuggugcucugggggauccaccaccccucgaccuccgccgaccagcagagccuguaccagaacgccgacgccuacguguucgucggcacgucccgguacucgaagaaguucaagcccgagaucgccauccgcccgaaggugcgggaccgcgagggccggaugaacuacuacuggacccugguggagcccggggacaagaucaccuucgaggcgaccggcaaccucgucgugccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggucaacuccgugaucgagaagaugaacacccaguucacggccgucggcaaggaguucaaccaccuggagaagcggaucgagaaccugaacaagaagguggacgacggcuuccucgacaucuggaccuacaacgccgagcugcuggugcuccuggagaacgagcgcacccuggacuaccacgacagcaacgucaagaaccucuacgagaaggugcggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgucaagcucgagagcacccggaucuaccagauccuggcgaucuacuccaccguggccucgagccuggugcucgucgugucccugggggccaucucguucuggaugugcuccaacggcagccugcagugccgcaucugcaucuga

SEQ ID NO: 5138 - RNA, 1701 nt, Artificial Sequence; identical to SEQ ID NO: 116
  derived and/or modified CDS sequence (AUadapt) from InfluenzaA__ADG57095__HA

SEQ ID NO: 5139 - RNA, 1701 nt, Artificial Sequence
  derived and/or modified CDS sequence (AUadapt) from InfluenzaA__ADG57097__HA
auggaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccggggccaggaggggcgcaugaacuacuacuggacgcugguggagcccggcgacaagaucaccuucgaggcgaccgggaaccucguggucccccgguacgccuucgccauggagcgcaacgccggcucgggcaucaucaucuccgacacccccgugcacgacugcaacacgaccugccagaccccgaagggggccaucaacaccagccugcccuuccacaacauccaccccaucacgaucggcaagugccccaaguacgugaaguccaccaagcugcggcucgcgaccgggcugcgcaacgucccgucgauccagucccggggccuguucggggccaucgccggcuucaucgagggcggguggaccggcaugguggacgggugguacggcuaccaccaccagaacgagcaggggagcggcuacgccgccgaccucaaguccacgcagaacgcgaucgacgagaucaccaacaaggugaacucggucaucgagaagaugaacacccaguucaccgccgugggcaaggaguucaaccaccuggagaagcgcaucgagaaccugaacaagaaggucgacgacggguuccucgacaucuggacguacaacgccgagcugcuggugcuccuggagaacgagcggacccuggacuaccacgacuccaacgugaagaaccucuacgagaagguccgcagccagcugaagaacaacgccaaggagaucggcaacgggugcuucgaguucuaccacaagugcgacaacacgugcauggaguccgugaagaacggcaccuacgacuaccccaaguacucggaggaggccaagcugaaccgggaggagaucgacggggugaagcucgaguccacccgcaucuaccagauccuggcgaucuacagcaccgucgccucgucccuggugcucguggucagccugggcgccaucuccuucuggaugugcagcaacggcucccugcagugccggaucugcaucuga

SEQ ID NO: 5140 - RNA, 1701 nt, Artificial Sequence; identical to SEQ ID NO: 4078
  derived and/or modified CDS sequence (AUadapt) from InfluenzaA__ADG57098__HA

SEQ ID NO: 5141 - RNA, 1701 nt, Artificial Sequence
  derived and/or modified CDS sequence (AUadapt) from InfluenzaA__ADG57099__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacucgaagaaguucaagcccgagaucgccauccgcccgaagguccgggaccaggagggccgcaugaacuaccacuggacccugguggagcccggggacaagaucaccuucgaggcgaccggcaaccucguggucccccgguacgccuucgccauggagcgcaacgccggguccggcaucaucaucacggacacccccgugcacgacugcaacacgaccugccagaccccgaagggcgccgugaacaccagccugcccuuccagaacauccaccccaucaccaucgggaagugccccaaguacgucaaguccaccaagcugcggcucgcgacgggccugcgcaacgugccgucgauccagucccgggggcuguucggcgccaucgccggguucaucgagggcggcuggaccgggaugguggacggcugguacggguaccaccaccagaacgagcagggcagcggguacgccgccgaccucaaguccacccagaacgcgaucgacaagaucaccaacaaggucaacucggugaucgagaagaugaacacgcaguucaccgccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacuccaacgucaagaaccucuacgagaaggugcgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgucaagcucgaguccacccgcaucuaccagauccuggcgaucuacucgaccguggccuccagccuggugcucgucgugucgcugggggccaucuccuucuggaugugcagcaacggcucccugcagugccggaucugcaucuga

SEQ ID NO: 5142 - RNA, 1701 nt, Artificial Sequence
  derived and/or modified CDS sequence (AUadapt) from InfluenzaA__ADG57100__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccggcggcaaggaguucaaccaccuggagaagcgcaucgagaaccugaacaagaagguggacgacggguuccucgacaucuggaccuacaacgccgagcugcugguccuccuggagaacgagcggacccuggacuaccacgacagcaacgugaagaaccucuacgagaaggugcgcucccagcugaagaacaacgccaaggagaucggcaacgggugcuucgaguucuaccacaagugcgacaacacgugcauggagucggucaagaacggcaccuacgacuaccccaaguacuccgaggaggccaagcugaaccgggaggagaucgacggggugaagcucgagagcacccgcaucuaccagauccuggcgaucuacuccaccguggccucgagccugguccucguggugucccugggcgccaucucguucuggaugugcuccaacggcagccugcagugccggaucugcaucuga

SEQ ID NO: 5143 - RNA, 1701 nt, Artificial Sequence; identical to SEQ ID NO: 116
  derived and/or modified CDS sequence (AUadapt) from InfluenzaA__ADG58939__HA

SEQ ID NO: 5144 - RNA, 1701 nt, Artificial Sequence; identical to SEQ ID NO: 116
  derived and/or modified CDS sequence (AUadapt) from InfluenzaA__ADG58940__HA

SEQ ID NO: 5145 - RNA, 1701 nt, Artificial Sequence
  derived and/or modified CDS sequence (AUadapt) from InfluenzaA__ADG58941__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacacguacguguucgugggcaccucccgguacucgaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcggcucgccacgggccugcgcaacgugccguccauccagagccgggggcuguucggcgcgaucgccggguucaucgagggcggcuggaccgggaugguggacggcugguacggguaccaccacgagaacgagcagggcuccggguacgccgccgaccucaagucgacccagaacgccaucgacgagaucaccaacaaggugaacuccgucaucgagaagaugaacacgcaguucaccgcggugggcaaggaguucaaccaccuggagaagcgcaucgagaaccugaacaagaagaucgacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggccaucuacuccaccguggcgucgagccugguccucguggugucccugggggccaucucguucuggaugugcuccaacggcagccugcagugccggaucugcaucuga

SEQ ID NO: 5146 - RNA, 1701 nt, Artificial Sequence
  derived and/or modified CDS sequence (AUadapt) from InfluenzaA__ADG58942__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacacguacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucucggacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagucgcgggggcuguucggcgcgaucgccggguucaucgagggcggcuggaccgggaugguggacggcugguacggguaccuccaccagaacgagcagggcuccggguacgccgccgaccucaagagcacccagaacgccaucgacgagaucaccaacaaggugaacuccgucaucgagaagaugaacacgcaguucaccgcggugggcaaggaguucaaccaccuggagaagcgcaucgagaaccugaacaagaagaucgacgacggcuuccuggacaucuggaccuacaacgccgagcugcucguccugcuggagaacgagcggacccucgacuaccacgacucgaacgugaagaaccuguacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcucaaccgggaggagaucgacggcgugaagcuggagucgacccgcaucuaccagauccuggccaucuacuccaccguggcgagcucgcucguccugguggugucccugggggccaucagcuucuggaugugcuccaacggcagccuccagugccggaucugcaucuga

SEQ ID NO: 5147 - RNA, 1701 nt, Artificial Sequence; identical to SEQ ID NO: 116
  derived and/or modified CDS sequence (AUadapt) from InfluenzaA__ADG58943__HA

SEQ ID NO: 5148 - RNA, 1701 nt, Artificial Sequence
  derived and/or modified CDS sequence (AUadapt) from InfluenzaA__ADG58944__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccuccuggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagucgaccaagcuccggcuggcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgugaucgagaagaugaacacccaguucacggccgucggcaaggaguucaaccaccuggagaagcgcaucgagaaccucaacaagaagguggacgacggcuuccuggacaucuggaccuacaacgccgagcugcucguccugcuggagaacgagcggacccucgacuaccacgacagcaacgugaagaaccuguacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcucaaccgggaggagaucgacggcgugaagcuggagagcacccgcaucuaccagauccuggcgaucuacuccaccguggccucgagccucguccugguggugucccugggggccaucucguucuggaugugcuccaacggcagccuccagugccggaucugcaucuga

SEQ ID NO: 5149 - RNA, 1701 nt, Artificial Sequence; identical to SEQ ID NO: 3712
  derived and/or modified CDS sequence (AUadapt) from InfluenzaA__ADG58946__HA

SEQ ID NO: 5150 - RNA, 1701 nt, Artificial Sequence; identical to SEQ ID NO: 116
  derived and/or modified CDS sequence (AUadapt) from InfluenzaA__ADG58947__HA

SEQ ID NO: 5151 - RNA, 1701 nt, Artificial Sequence
  derived and/or modified CDS sequence (AUadapt) from InfluenzaA__ADG58948__HA
augaaggccauccugaucgugcuccuguacaccuucgccaccgcgaacgccgacacgcugugcaucggcuaccacgccaacaacucgaccgacaccgucgacaccgugcucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagucgcuguccaccgccagcuccuggucguacaucgucgagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggugaccgccgccugcccgcacgccggcgcgaaguccuucuacaagaaccugaucuggcucgucaagaaggggaacucguaccccaagcuguccaagagcuacaucaacgacaagggcaaggaggugcuggugcucugggggauccaccaccccucgaccuccgccgaccagcagagccuguaccagaacgccgacacguacgucuucgugggcaccucccgguacucgaagaaguucaagcccgagaucgccauccgcccgaaggugcgggaccaggagggccgcaugaacuacuacuggacccuggucgagcccggggacaagaucaccuucgaggccacgggcaaccucguggugccccgguacgcguucgccauggagcgcaacgccggguccggcaucaucaucagcgacacccccguccacgacugcaacacgaccugccagaccccgaagggcgccaucaacaccucccugcccuuccagaacauccaccccaucaccaucgggaagugccccaaguacgucaagucgaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacgagaucaccaacaaggugaacuccgugaucgagaagaugaacacgcaguucaccgcggucggcaaggaguucaaccaccuggagaagcgcaucgagaaccugaacaagaagaucgacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgucaagcucgagagcacccgcaucuaccagauccuggccaucuacuccaccguggcgucgagccuggugcucgucgugucccugggggccaucucguucuggaugugcuccaacggcagccugcagugccggaucugcaucuga

SEQ ID NO: 5152 - RNA, 1701 nt, Artificial Sequence
  derived and/or modified CDS sequence (AUadapt) from InfluenzaA__ADG58949__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacacguacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucucggacaccuccgugcacgacugcaacacgaccugccagacccccaagggcgccaucaacaccagccugccguuccagaacauccaccccaucaccaucgggaagugccccaaguacgugaaguccaccaagcugcggcucgccacgggccugcgcaacguccccucgauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacgagaucaccaacaaggugaacucggucaucgagaagaugaacacgcaguucaccgcggugggcaaggaguucaaccaccuggagaagcgcaucgagaaccugaacaagaagaucgacgacggcuuccucgacaucuggaccuacaacgccgagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuacccgaaguacucggaggaggccaagcugaaccgggaggagaucgacggcgugaagcucgaguccacccgcaucuaccagauccuggccaucuacagcaccguggcgucgucccugguccucguggugagccugggggccaucuccuucuggaugugcagcaacggcucccugcagugccggaucugcaucuga

SEQ ID NO: 5153 - RNA, 1701 nt, Artificial Sequence
  derived and/or modified CDS sequence (AUadapt) from InfluenzaA__ADG58951__HA
augaaggccauccuggugguccuccugcacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccaacagcggcaacggcacgugcuaccccggggaguucaucgacuacgaggagcuccgggagcagcuguccucgguguccucguucgagcgcuucgagaucuuccccaagaccuccagcuggcccaaccacgacuccaacaagggcgucaccgccgccugcccgcacgccggggccaagucguucuacaagaaccugaucuggcucgugaagaagggcaacuccuaccccaagcugagcaaguccuacaucaacgacaaggggaaggaggugcugguccucuggggcauccaccaccccucgaccagcgccgaccagcagucccuguaccagaacgccgacgccuacguguucgugggcacgucgcgguacuccaagaaguucaagcccgagaucgccauccgcccgaagguccgggaccaggaggggcgcaugaacuacuacuggacccugguggagcccggcgacaagaucaccuucgaggcgaccgggaaccucguggucccccgguacgccuucgccauggagcgcaacgccggcucgggcaucaucaucuccgacacgcccgugcacgacugcaacacgaccugccagaccccgaagggggccaucaacaccagccugcccuuccagaacauccaccccaucaccaucggcaagugccccaaguacgugaaguccaccaagcugcggcucgcgaccgggcugcgcaacgucccgucgauccagucccggggccuguucggggccaucgccggcuucaucgagggcggguggacgggcaugguggacgggugguacggcuaccaccaccagaacgagcaggggagcggcuacgccgccgaccucaaguccacccagaacgcgaucgacgagaucaccaacaaggugaacucggucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucggcaacgggugcuucgaguucuaccacaagugcgacaacacgugcaucgaguccgugaagaacggcaccuacgacuaccccaaguacagcgaggaggccaagcugaaccgggaggagaucgacggggugaagcucgaguccacccgcaucuaccagauccuggcgaucuacucgaccgucgccuccagccuggugcucguggucucgcugggcgccaucuccuucuggaugugcagcaacggcucccugcagugccggaucugcaucuga

SEQ ID NO: 5154 - RNA, 1701 nt, Artificial Sequence; identical to SEQ ID NO: 5153
  derived and/or modified CDS sequence (AUadapt) from InfluenzaA__ADG58952__HA

SEQ ID NO: 5155 - RNA, 1701 nt, Artificial Sequence; identical to SEQ ID NO: 5153
  derived and/or modified CDS sequence (AUadapt) from InfluenzaA__ADG58953__HA

SEQ ID NO: 5156 - RNA, 1701 nt, Artificial Sequence; identical to SEQ ID NO: 5153
  derived and/or modified CDS sequence (AUadapt) from InfluenzaA__ADG58954__HA

SEQ ID NO: 5157 - RNA, 1701 nt, Artificial Sequence; identical to SEQ ID NO: 5153
  derived and/or modified CDS sequence (AUadapt) from InfluenzaA__ADG58955__HA

SEQ ID NO: 5158 - RNA, 1701 nt, Artificial Sequence; identical to SEQ ID NO: 5153
  derived and/or modified CDS sequence (AUadapt) from InfluenzaA__ADG58956__HA

SEQ ID NO: 5159 - RNA, 1701 nt, Artificial Sequence
  derived and/or modified CDS sequence (AUadapt) from InfluenzaA__ADG58957__HA
augaaggccauccuggugguccuccugcacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccaacagcggcaacggcacgugcuaccccggggaguucaucgacuacgaggagcuccgggagcagcuguccucgguguccucguucgagcgcuucgagaucuuccccaagaccuccagcuggcccaaccacgacuccaacaagggcgucaccgccgccugcccgcacgccggggccaagucguucuacaagaaccugaucuggcucgugaagaagggcaacuccuaccccaagcugagcaaguccuacaucaacgacaaggggaaggaggugcugguccucuggggcauccaccaccccucgaccagcgccgaccagcagucccuguaccagaacgccgacgccuacguguucgugggcacgucgcgguacuccaagaaguucaagcccgagaucgccauccgcccgaagguccgggaccaggaggggcgcaugaacuacuacuggacccugguggagcccggcgacaagaucaccuucgaggcgaccgggaaccucguggucccccgguacgccuucgccauggagcgcaacgccggcucgggcaucaucaucuccgacacgcccgugcacgacugcaacacgaccugccagaccccgaagggggccaucaacaccagccugcccuuccagaacauccaccccaucaccaucggcaagugccccaaguacgugaaguccaccaagcugcggcucgcgaccgggcugcgcaacgucccgucgauccagucccggggccuguucggggccaucgccggcuucaucgagggcggguggacgggcaugguggacgggugguacggcuaccaccaccagaacgagcaggggagcggcuacgccgccgaccucaaguccacccagaacgcgaucgacgagaucaccaacaaggugaacucggucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcaucuaccagauccuggcgaucuacucgaccgucgccuccagccuggugcucguggucucgcugggcgccaucuccuucuggaugugcagcaacggcucccugcagugccggaucugcaucuga

SEQ ID NO: 5160 - RNA, 1701 nt, Artificial Sequence
  derived and/or modified CDS sequence (AUadapt) from InfluenzaA__ADG58959__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgaacagcugguccuacaucguggagaccucguccagcgacaacggcacgugcuaccccggcgacuucaucgacuacgaggagcuccgggagcagcuguccucgguguccagcuucgagcgcuucgagaucuuccccaagaccuccucguggcccaaccacgacuccaacaagggggucaccgccgccugcccgcacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacguguucgugggcacgucgcgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccucgcugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcucgggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 5161 - RNA, 1701 nt, Artificial Sequence; identical to SEQ ID NO: 5078
  derived and/or modified CDS sequence (AUadapt) from InfluenzaA__ADG58960__HA

SEQ ID NO: 5162 - RNA, 1701 nt, Artificial Sequence; identical to SEQ ID NO: 5078
  derived and/or modified CDS sequence (AUadapt) from InfluenzaA__ADG58961__HA

SEQ ID NO: 5163 - RNA, 1701 nt, Artificial Sequence; identical to SEQ ID NO: 5078
  derived and/or modified CDS sequence (AUadapt) from InfluenzaA__ADG58962__HA

SEQ ID NO: 5164 - RNA, 1701 nt, Artificial Sequence; identical to SEQ ID NO: 5078
  derived and/or modified CDS sequence (AUadapt) from InfluenzaA__ADG58963__HA

SEQ ID NO: 5165 - RNA, 1701 nt, Artificial Sequence; identical to SEQ ID NO: 5078
  derived and/or modified CDS sequence (AUadapt) from InfluenzaA__ADG58964__HA

SEQ ID NO: 5166 - RNA, 1701 nt, Artificial Sequence; identical to SEQ ID NO: 5078
  derived and/or modified CDS sequence (AUadapt) from InfluenzaA__ADG58965__HA

SEQ ID NO: 5167 - RNA, 1701 nt, Artificial Sequence; identical to SEQ ID NO: 5078
  derived and/or modified CDS sequence (AUadapt) from InfluenzaA__ADG58966__HA

SEQ ID NO: 5168 - RNA, 1701 nt, Artificial Sequence; identical to SEQ ID NO: 5078
  derived and/or modified CDS sequence (AUadapt) from InfluenzaA__ADG58967__HA

SEQ ID NO: 5169 - RNA, 1701 nt, Artificial Sequence; identical to SEQ ID NO: 5078
  derived and/or modified CDS sequence (AUadapt) from InfluenzaA__ADG58968__HA

SEQ ID NO: 5170 - RNA, 1701 nt, Artificial Sequence; identical to SEQ ID NO: 116
  derived and/or modified CDS sequence (AUadapt) from InfluenzaA__ADG59628__HA

SEQ ID NO: 5171 - RNA, 1701 nt, Artificial Sequence; identical to SEQ ID NO: 116
  derived and/or modified CDS sequence (AUadapt) from InfluenzaA__ADG59629__HA

SEQ ID NO: 5172 - RNA, 1701 nt, Artificial Sequence; identical to SEQ ID NO: 116
  derived and/or modified CDS sequence (AUadapt) from InfluenzaA__ADG59630__HA

SEQ ID NO: 5173 - RNA, 1701 nt, Artificial Sequence; identical to SEQ ID NO: 116
  derived and/or modified CDS sequence (AUadapt) from InfluenzaA__ADG59631__HA

SEQ ID NO: 5174 - RNA, 1701 nt, Artificial Sequence; identical to SEQ ID NO: 116
  derived and/or modified CDS sequence (AUadapt) from InfluenzaA__ADG59632__HA

SEQ ID NO: 5175 - RNA, 1701 nt, Artificial Sequence; identical to SEQ ID NO: 4015
  derived and/or modified CDS sequence (AUadapt) from InfluenzaA__ADG59633__HA

SEQ ID NO: 5176 - RNA, 1701 nt, Artificial Sequence; identical to SEQ ID NO: 4015
  derived and/or modified CDS sequence (AUadapt) from InfluenzaA__ADG59634__HA

SEQ ID NO: 5177 - RNA, 1701 nt, Artificial Sequence; identical to SEQ ID NO: 116
  derived and/or modified CDS sequence (AUadapt) from InfluenzaA__ADG59635__HA

SEQ ID NO: 5178 - RNA, 1701 nt, Artificial Sequence
  derived and/or modified CDS sequence (AUadapt) from InfluenzaA__ADG59636__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccggggccaggaggggcgcaugaacuacuacuggacccugguggagcccggcgacaagaucaccuucgaggcgaccgggaaccucguggucccccgguacgccuucgccauggagcgcaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagucgaccaagcugcggcucgcgaccgggcugcgcaacaucccguccauccagagccggggccuguucggggccaucgccggcuucaucgagggcggguggacgggcaugguggacgggugguacggcuaccaccaccagaacgagcagggguccggcuacgccgccgaccucaagucgacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggguuccucgacaucuggaccuacaacgccgagcugcugguccuccuggagaacgagcggacccuggacuaccacgacagcaacgugaagaaccucuacgagaaggugcgcucccagcugaagaacaacgccaaggagaucggcaacgggugcuucgaguucuaccacaagugcgacaacacgugcauggagucggucaagaacggcaccuacgacuaccccaaguacuccgaggaggccaagcugaaccgggaggagaucgacggggugaagcucgagagcacccgcaucuaccagauccuggcgaucuacuccaccguggccucgagccugguccucguggugucccugggcgccaucucguucuggaugugcuccaacggcagccugcagugccggaucugcaucuga

SEQ ID NO: 5179 - RNA, 1701 nt, Artificial Sequence; identical to SEQ ID NO: 3662
  derived and/or modified CDS sequence (AUadapt) from InfluenzaA__ADG59638__HA

SEQ ID NO: 5180 - RNA, 1701 nt, Artificial Sequence; identical to SEQ ID NO: 4015
  derived and/or modified CDS sequence (AUadapt) from InfluenzaA__ADG59639__HA

SEQ ID NO: 5181 - RNA, 1701 nt, Artificial Sequence; identical to SEQ ID NO: 3267
  derived and/or modified CDS sequence (AUadapt) from InfluenzaA__ADG59641__HA

SEQ ID NO: 5182 - RNA, 1701 nt, Artificial Sequence; identical to SEQ ID NO: 3757
  derived and/or modified CDS sequence (AUadapt) from InfluenzaA__ADG59643__HA

SEQ ID NO: 5183 - RNA, 1701 nt, Artificial Sequence; identical to SEQ ID NO: 62
  derived and/or modified CDS sequence (AUadapt) from InfluenzaA__ADG59644__HA

SEQ ID NO: 5184 - RNA, 1701 nt, Artificial Sequence; identical to SEQ ID NO: 116
  derived and/or modified CDS sequence (AUadapt) from InfluenzaA__ADG59646__HA

SEQ ID NO: 5185 - RNA, 1701 nt, Artificial Sequence; identical to SEQ ID NO: 4015
  derived and/or modified CDS sequence (AUadapt) from InfluenzaA__ADG59647__HA

SEQ ID NO: 5186 - RNA, 1701 nt, Artificial Sequence; identical to SEQ ID NO: 4078
  derived and/or modified CDS sequence (AUadapt) from InfluenzaA__ADG59648__HA

SEQ ID NO: 5187 - RNA, 1701 nt, Artificial Sequence; identical to SEQ ID NO: 4078
  derived and/or modified CDS sequence (AUadapt) from InfluenzaA__ADG59649__HA

SEQ ID NO: 5188 - RNA, 1701 nt, Artificial Sequence; identical to SEQ ID NO: 4078
  derived and/or modified CDS sequence (AUadapt) from InfluenzaA__ADG59650__HA

SEQ ID NO: 5189 - RNA, 1701 nt, Artificial Sequence; identical to SEQ ID NO: 4078
  derived and/or modified CDS sequence (AUadapt) from InfluenzaA__ADG59651__HA

SEQ ID NO: 5190 - RNA, 1701 nt, Artificial Sequence; identical to SEQ ID NO: 116
  derived and/or modified CDS sequence (AUadapt) from InfluenzaA__ADG59652__HA

SEQ ID NO: 5191 - RNA, 1701 nt, Artificial Sequence; identical to SEQ ID NO: 116
  derived and/or modified CDS sequence (AUadapt) from InfluenzaA__ADG59653__HA

SEQ ID NO: 5192 - RNA, 1701 nt, Artificial Sequence; identical to SEQ ID NO: 5178
  derived and/or modified CDS sequence (AUadapt) from InfluenzaA__ADG59655__HA

SEQ ID NO: 5193 - RNA, 1701 nt, Artificial Sequence; identical to SEQ ID NO: 4015
  derived and/or modified CDS sequence (AUadapt) from InfluenzaA__ADG59656__HA

SEQ ID NO: 5194 - RNA, 1701 nt, Artificial Sequence
  derived and/or modified CDS sequence (AUadapt) from InfluenzaA__ADG59657__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcuccucgaaguacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccucgcugcccuuccagaacauccaccccaucacgaucgggaagugccccaaguacgugaaguccaccaagcugcgccucgcgaccggccugcggaacgucccgagcacccagucccgcgggcuguucggcgccaucgccggguucaucgagggcggcuggacggggaugguggacggcugguacggguaccaccaccagaacgagcagggcucgggguacgccgccgaccucaaguccacccagaacgcgaucgacgagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaacgugaagaaccucuacgagaagguccggucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgugaagcucgaguccacccggaucuaccagauccuggcgaucuacucgaccgucgccagcucccuggugcucguggucucgcugggggccaucuccuucuggaugugcagcaacggcucccugcagugccgcaucugcaucuga

SEQ ID NO: 5195 - RNA, 1701 nt, Artificial Sequence
  derived and/or modified CDS sequence (AUadapt) from InfluenzaA__ADG59658__HA
augaaggccauccuggugguccuccuguacaccuucgccaccgcgaacgccgacacgcugugcaucggcuaccacgccaacaacucgaccgacaccaucgacaccgugcucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagucgcuguccaccgccagcuccuggucguacaucgucgagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggugaccgccgccugcccgcacgccggcgcgaaguccuucuacaagaaccugaucuggcucgucaagaaggggaacucguaccccaagcuguccaagagcuacaucaacgacaagggcaaggaggugcuggugcucugggggauccaccaccccucgaccuccgccgaccagcagagccuguaccagaacgccgacgccuacgucuucgugggcacgucccgguacucgaagaaguucaagcccgagaucgccauccgcccgaaggugcggaaccaggagggccgcaugaacuacuacuggacccuggucgagcccggggacaagaucaccuucgaggcgaccggcaaccucguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacaucccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgugaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgucaagcucgagagcacccgcaucuaccagauccuggcgaucuacuccaccguggccucgagccuggugcucgucgugucccugggggccaucucguucuggaugugcuccaacggcagccugcagugccggaucugcaucuga

SEQ ID NO: 5196 - RNA, 1701 nt, Artificial Sequence; identical to SEQ ID NO: 3361
  derived and/or modified CDS sequence (AUadapt) from InfluenzaA__ADG59659__HA

SEQ ID NO: 5197 - RNA, 1701 nt, Artificial Sequence; identical to SEQ ID NO: 3361
  derived and/or modified CDS sequence (AUadapt) from InfluenzaA__ADG59660__HA

SEQ ID NO: 5198 - RNA, 1701 nt, Artificial Sequence; identical to SEQ ID NO: 3267
  derived and/or modified CDS sequence (AUadapt) from InfluenzaA__ADG59662__HA

SEQ ID NO: 5199 - RNA, 1701 nt, Artificial Sequence
  derived and/or modified CDS sequence (AUadapt) from InfluenzaA__ADG59663__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccuuccacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacaucccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagucgacccgcaucuaccagauccuggcgaucuacuccaccguggccagcucgcuggugcucgucgugucccugggggccaucagcuucuggaugugcuccaacggcagccugcagugccggaucugcaucuga

SEQ ID NO: 5200 - RNA, 1701 nt, Artificial Sequence; identical to SEQ ID NO: 3267
  derived and/or modified CDS sequence (AUadapt) from InfluenzaA__ADG59664__HA

SEQ ID NO: 5201 - RNA, 1701 nt, Artificial Sequence
  derived and/or modified CDS sequence (AUadapt) from InfluenzaA__ADG59666__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcgacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaagaucgacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccgccguggccucgagccugguccucguggugucccugggggccaucucguucuggaugugcuccaacggcagccugcagugccggaucugcaucuga

SEQ ID NO: 5202 - RNA, 1701 nt, Artificial Sequence; identical to SEQ ID NO: 4016
  derived and/or modified CDS sequence (AUadapt) from InfluenzaA__ADG59667__HA

SEQ ID NO: 5203 - RNA, 1701 nt, Artificial Sequence
  derived and/or modified CDS sequence (AUadapt) from InfluenzaA__ADG59669__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggagcaggagggccgcaugaacuacuacuggacccugguggaccccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccacagcaucaccaucgggaagugccccaaguacgugaaguccaccaagcugcggcucgcgaccggccugcgcaacguccccucgauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacucggucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuacccgaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 5204 - RNA, 1701 nt, Artificial Sequence; identical to SEQ ID NO: 5203
  derived and/or modified CDS sequence (AUadapt) from InfluenzaA__ADG59670__HA

SEQ ID NO: 5205 - RNA, 1701 nt, Artificial Sequence; identical to SEQ ID NO: 5203
  derived and/or modified CDS sequence (AUadapt) from InfluenzaA__ADG59671__HA

SEQ ID NO: 5206 - RNA, 1701 nt, Artificial Sequence; identical to SEQ ID NO: 5203
  derived and/or modified CDS sequence (AUadapt) from InfluenzaA__ADG59672__HA

SEQ ID NO: 5207 - RNA, 1701 nt, Artificial Sequence
  derived and/or modified CDS sequence (AUadapt) from InfluenzaA__ADG59673__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccguggaccugcuggaggacaagcacaacgggaagcucugcaagcugcgcggcgucgcgccccugcaccucggggagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 5208 - RNA, 1701 nt, Artificial Sequence
  derived and/or modified CDS sequence (AUadapt) from InfluenzaA__ADG59674__HA
augaaggccauccuggugguccuccuguacaccuucgccaccgcgaacgccgacacgcugugcgugggcuaccacgccaacaacucgaccgacaccguggacaccguccucgagaagaacgugacggugacccacuccgucaaccugcuggaggacaagcacaacgggaagcucugcaagcugcgcggcguggcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgucagcuccuucgagcgcuucgagaucuuccccaagaccucguccuggcccaaccacgacagcaacaagggggugaccgccgccugcccgcacgccggcgcgaaguccuucuacaagaaccugaucuggcucgugaagaaggggaacucguaccccaagcuguccaagagcuacaucaacgacaagggcaaggagguccuggugcucugggggauccaccaccccucgaccuccgccgaccagcagagccuguaccagaacgccgacgccuacguguucgucggcacgucccgguacucgaagaaguucaagcccgagaucgccauccgcccgaaggugcgggagcaggagggccgcaugaacuacuacuggacccugguggagcccggggacaagaucaccuucgaggcgaccggcaaccucgucgugccccgguacgccuucgccauggagcgcaacgccggguccggcaucaucaucagcgacacgcccgugcacgacugcaacacgaccugccagaccccgaagggcgccaucaacaccucccugcccuuccagaacguccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcaccaagaucuaccagauccuggcgaucuacuccaccguggccucgagccugguccucguggugucccugggggccaucucguucuggaugugcuccaacggcagccugcagugccgcaucugcaucuga

SEQ ID NO: 5209 - RNA, 1701 nt, Artificial Sequence
  derived and/or modified CDS sequence (AUadapt) from InfluenzaA__ADG59675__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggucgggcaucaucaucuccgacacccccgugcacgacugcaacacgaccugccagaccccgaacggcgccaucaacaccagccugcccuuccacaacauccaccccaucacgaucgggaagugccccaaguacgugaaguccaccaagcugcggcucgcgaccggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 5210 - RNA, 1701 nt, Artificial Sequence
  derived and/or modified CDS sequence (AUadapt) from InfluenzaA__ADG59676__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacgcgaccugccagaccccgaagggcgccaucaacaccucccugcccuuccagaacauccaccccaucacgaucgggaagugccccaaguacgucaagucgaccaagcugcggcucgccaccggccugcgcaacaucccguccauccagagccgggggcuguucggcgccaucgccggguucaucgagggcggcuggaccgggaugguggacggcugguacggguaccaccaccagaacgagcagggcuccggguacgccgcggaccucaagucgacgcagaacgccaucgacgagaucaccaacaaggugaacuccgugaucgagaagaugaacacccaguucaccgccgucggcaaggaguucaaccaccuggagaagcgcaucgagaaccugaacaagaagguggacgacggcuuccucgacaucuggacguacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggcgaagcugaaccgggaggagaucgacggcgugaagcucgagagcacccgcaucuaccagauccuggccaucuacuccaccguggccucgagccugguccucguggugucccugggggccaucucguucuggaugugcuccaacggcagccugcagugccggaucugcaucuga

SEQ ID NO: 5211 - RNA, 1701 nt, Artificial Sequence; identical to SEQ ID NO: 4015
  derived and/or modified CDS sequence (AUadapt) from InfluenzaA__ADG59678__HA

SEQ ID NO: 5212 - RNA, 1701 nt, Artificial Sequence; identical to SEQ ID NO: 5178
  derived and/or modified CDS sequence (AUadapt) from InfluenzaA__ADG59680__HA

SEQ ID NO: 5213 - RNA, 1701 nt, Artificial Sequence; identical to SEQ ID NO: 5178
  derived and/or modified CDS sequence (AUadapt) from InfluenzaA__ADG59681__HA

SEQ ID NO: 5214 - RNA, 1701 nt, Artificial Sequence
  derived and/or modified CDS sequence (AUadapt) from InfluenzaA__ADG59683__HA
augaaggccauccuggugguccuccuguacaccuucgccaucgcgaacgccgacacccugugcaucggcuaccacgccaacaacucgacggacaccguggacaccgugcucaagaagaacgucaccgugacgcacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacgggaccugcuaccccggcgacuucaucgacuacgaggagcuccgggagcagcugagcuccgugucguccuucgagcgcuucgagaucuuccccaagacgagcuccuggcccaaccacgacucgaacaagggcgucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcaccucccgguacagcaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccggguccggcaucgugaucucggacacccccgugcacgacugcaacacgaccugccagaccccgaagggcgccaucaacaccucccugcccuuccagaacauccaccccaucacgaucgggaagugccccaaguacgucaagagcaccaagcugcggcucgcgaccggccugcgcaacgugccguccauccagucgcgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggucaacuccgugaucgagaagaugaacacccaguucaccgccgucggcaaggaguucaaccaccuggagaagcgcaucgagaaccugaacaagaagguggacgacggcuuccucgacaucuggacguacaacgccgagcugcuggugcuccuggagaacgagcggacccuggacuaccacgacucgaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagucgacccgcaucuaccagauccuggcgaucuacuccaccguggccagcucgcuggugcucgucgugucccugggggccaucagcuucuggaugugcuccaacggcagccugcagugccggaucugcaucuga

SEQ ID NO: 5215 - RNA, 1701 nt, Artificial Sequence; identical to SEQ ID NO: 4015
  derived and/or modified CDS sequence (AUadapt) from InfluenzaA__ADG59684__HA

SEQ ID NO: 5216 - RNA, 1701 nt, Artificial Sequence
  derived and/or modified CDS sequence (AUadapt) from InfluenzaA__ADG59685__HA
augaaggccauccuggugguccuccuguacaccuucgccaccgcgaacgccgacacgcugugcaucggcuaccacgccaacaacucgaccgacaccaucgacaccgugcucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagucgcuguccaccgccagcuccuggucguacaucgucgagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggugaccgccgccugcccgcacgccggcgcgaaguccuucuacaagaaccugaucuggcucgucaagaaggggaacucguaccccaagcuguccaagagcuacaucaacgacaagggcaaggaggugcuggugcucugggggauccaccaccccucgaccuccgccgaccagcagagccuguaccagaacgccgacgccuacgucuucgugggcacgucccgguacucgaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacaucccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgugaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgucaagcucgagagcacccgcaucuaccagauccuggcgaucuacuccaccguggccucgagccuggugcucgucgugucccugggggccaucucguucuggaugugcuccaacggcagccugcagugccggaucugcaucuga

SEQ ID NO: 5217 - RNA, 1701 nt, Artificial Sequence; identical to SEQ ID NO: 4015
  derived and/or modified CDS sequence (AUadapt) from InfluenzaA__ADG59686__HA

SEQ ID NO: 5218 - RNA, 1701 nt, Artificial Sequence; identical to SEQ ID NO: 5178
  derived and/or modified CDS sequence (AUadapt) from InfluenzaA__ADG59687__HA

SEQ ID NO: 5219 - RNA, 1701 nt, Artificial Sequence
  derived and/or modified CDS sequence (AUadapt) from InfluenzaA__ADG59688__HA
augaaggccauccuggugguccuccuguacaccaucgccaccgcgaacgccgacacgcugugcaucggcuaccacgccaacaacucgaccgacaccaucgacaccgugcucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagucgcuguccaccgccagcuccuggucguacaucgucgagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggugaccgccgccugcccgcacgccggcgcgaaguccuucuacaagaaccugaucuggcucgucaagaaggggaacagcuaccccaagcuguccaagucguacaucaacgacaagggcaaggaggugcuggugcucugggggauccaccaccccagcaccuccgccgaccagcagucgcuguaccagaacgccgacgccuacgucuucgugggcacgucccgguacagcaagaaguucaagcccgagaucgccauccgcccgaaggugcggggccaggaggggcgcaugaacuacuacuggacccuggucgagcccggcgacaagaucaccuucgaggcgaccgggaaccucguggugccccgguacgccuucgccauggagcgcaacgccggcuccggcaucaucaucucggacacgcccguccacgacugcaacacgaccugccagaccccgaagggggccaucaacaccucccugcccuuccagaacauccaccccaucaccaucggcaagugccccaaguacgucaagagcaccaagcugcggcucgcgaccgggcugcgcaacaucccguccauccagucgcggggccuguucggggccaucgccggcuucaucgagggcggguggacgggcaugguggacgggugguacggcuaccaccaccagaacgagcagggguccggcuacgccgccgaccucaagucgacccagaacgcgaucgacgagaucaccaacaaggugaacuccgugaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggucaagcucgagagcacccgcaucuaccagauccuggcgaucuacuccaccguggccucgagccuggugcucgucgugucccugggcgccaucucguucuggaugugcuccaacggcagccugcagugccggaucugcaucuga

SEQ ID NO: 5220 - RNA, 1701 nt, Artificial Sequence; identical to SEQ ID NO: 116
  derived and/or modified CDS sequence (AUadapt) from InfluenzaA__ADG59689__HA

SEQ ID NO: 5221 - RNA, 1701 nt, Artificial Sequence; identical to SEQ ID NO: 116
  derived and/or modified CDS sequence (AUadapt) from InfluenzaA__ADG59691__HA

SEQ ID NO: 5222 - RNA, 1701 nt, Artificial Sequence
  derived and/or modified CDS sequence (AUadapt) from InfluenzaA__ADG59693__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccggaaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacaucccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgagccugguccucguggugucccugggggccaucucguucuggaugugcuccaacggcagccugcagugccggaucugcaucuga

SEQ ID NO: 5223 - RNA, 1701 nt, Artificial Sequence
  derived and/or modified CDS sequence (AUadapt) from InfluenzaA__ADG59696__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcgacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 5224 - RNA, 1701 nt, Artificial Sequence
  derived and/or modified CDS sequence (AUadapt) from InfluenzaA__ADG59697__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaagaacuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacguguucgugggcacgucgcgguacuccaagaaguucaagcccgagaucgccauccgcccgaagguccggggccaggaggggcgcaugaacuacuacuggacccugguggagcccggcgacaagaucaccuucgaggcgaccgggaaccucguggucccccgguacgccuucgccauggagcgcaacgccggcagcggcaucaucaucuccgacacgcccgugcacgacugcaacacgaccugccagaccccgaagggggccaucaacaccucgcugcccuuccagaacauccaccccaucaccaucggcaagugccccaaguacgugaaguccaccaagcugcggcucgcgaccgggcugcgcaacgucccgagcauccagucccggggccuguucggggccaucgccggcuucaucgagggcggguggacgggcaugguggacgggugguacggcuaccaccaccagaacgagcaggggucgggcuacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcaucuaccagauccuggcgaucuacucgaccgucgccuccagccuggugcucguggucucgcugggcgccaucuccuucuggaugugcagcaacggcucccugcagugccggaucugcaucuga

SEQ ID NO: 5225 - RNA, 1701 nt, Artificial Sequence
  derived and/or modified CDS sequence (AUadapt) from InfluenzaA__ADG59700__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagacccugaagggcgccaucaacaccucccugccguuccagaacauccaccccaucaccaucgggaagugccccaaguacgucaagagcaccaagcuccggcuggcgaccggccugcgcaacauccccuccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcgcaucgagaaccucaacaagaagguggacgacggcuuccuggacaucuggaccuacaacgccgagcugcucguccugcuggagaacgagcggacccucgacuaccacgacucgaacgugaagaaccuguacgagaaggugcgcucccagcugaagaacaacgccaaggagaucgggaacggcugcuucgaguucuaccacaagugcgacaacacgugcauggagagcgucaagaacgggaccuacgacuacccgaaguacuccgaggaggccaagcucaaccgggaggagaucgacggcgugaagcuggagucgacccgcaucuaccagauccuggcgaucuacuccaccguggccagcucgcucguccugguggugucccugggggccaucagcuucuggaugugcuccaacggcagccuccagugccggaucugcaucuga

SEQ ID NO: 5226 - RNA, 1701 nt, Artificial Sequence
  derived and/or modified CDS sequence (AUadapt) from InfluenzaA__ADG59701__HA
augaaggccauccuggugguccuccuguacaccuucgccgcggccaacgccgacacccugugcaucggcuaccacgccaacaacucgacggacaccguggacaccgugcucgagaagaacgucaccgugacgcacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacgggaccugcuaccccggcgacuucaucgacuacgaggagcuccgggagcagcugucguccgugagcuccuucgagcgcuucgagaucuuccccaagacgucguccuggcccaaccacgacagcaacaagggcgucaccgccgccugcccgcacgcgggcgccaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcaccucccgguacucgaagaaguucaagcccgagaucgcgauccgcccgaagguccgggaccaggagggccgcaugaacuacuacuggacgcugguggagcccggggacaagaucaccuucgaggccaccggcaaccucguggucccccgguacgccuucgccauggagcgcaacgccggguccggcaucaucaucagcgacacccccgugcacgacugcaacacgaccugccagaccccgaagggcgcgaucaacaccucccugcccuuccagaacauccaccccaucacgaucgggaagugccccaaguacgucaagucgaccaagcugcggcucgccaccggccugcgcaacgugccguccauccagagccgggggcuguucggcgccaucgccggguucaucgagggcggcuggaccgggaugguggacggcugguacggguaccaccaccagaacgagcagggcuccggguacgccgcggaccucaagucgacgcagaacgccaucgacaagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggcgaagcugaaccgggaggagaucgacggcgugaagcucgagagcacccgcaucuaccagauccuggccaucuacuccaccgucgccucgagccuggugcucguggucucccugggggccaucucguucuggaugugcuccaacggcagccugcagugccggaucugcaucuga

SEQ ID NO: 5227 - RNA, 1701 nt, Artificial Sequence
  derived and/or modified CDS sequence (AUadapt) from InfluenzaA__ADG59702__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacaucccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggaaccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgagccugguccucguggugucccugggggccaucucguucuggaugugcuccaacggcagccugcagugccggaucugcaucuga

SEQ ID NO: 5228 - RNA, 1701 nt, Artificial Sequence
  derived and/or modified CDS sequence (AUadapt) from InfluenzaA__ADG59703__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacccgaacaagggggucaccgccgccugcccccacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacguguucgugggcacgucgcgguacuccaagaaguucaagccggagaucgccauccgccccaagguccgggaccaggagggccgcaugaacuacuacuggacccugguggagcccggggacaagaucaccuucgaggcgaccggcaaccucguggucccccgguacgccuucgccauggagcgcaacgccgggagcggcaucgugaucuccgacacgccggugcacgacugcaacacgaccugccagacccccaagggcgccaucaacaccucgcugcccuuccagaacauccaccccaucaccaucgggaagugcccgaaguacgucaaguccaccaagcugcggcucgcgaccggccugcgcaacgugcccagcauccagucccgggggcuguucggcgccaucgccggguucaucgagggcggcuggacggggaugguggacggcugguacggguaccaccaccagaacgagcagggcucgggguacgccgccgaccucaaguccacccagaacgcgaucgacgagaucaccaacaaggucaacagcgugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacuccaacgucaagaaccucuacgagaaggugcgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgucaagcucgaguccacccgcaucuaccagauccuggcgaucuacucgaccguggccuccagccuggugcucgucgugucgcugggggccaucuccuucuggaugugcagcaacggcucccugcagugccggaucugcaucuga

SEQ ID NO: 5229 - RNA, 1701 nt, Artificial Sequence; identical to SEQ ID NO: 92
  derived and/or modified CDS sequence (AUadapt) from InfluenzaA__ADG76646__HA

SEQ ID NO: 5230 - RNA, 1701 nt, Artificial Sequence
  derived and/or modified CDS sequence (AUadapt) from InfluenzaA__ADG76652__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagcuucuccaccucguccagcugguccuacaucguggagacccccucguccgacaacggcacgugcuaccccggcgacuucaucgacuacgaggagcugcgggagcagcucagcuccgugucguccuucgagcgcuucgagaucuuccccaagaccagcuccuggccgaaccacgacagcaacaagggggucaccgccgccugcccccacgccggcgccaaguccuucuacaagaaccugaucuggcuggugaagaaggggaacucguaccccaagcucuccaagagcuacaucaacgacaagggcaaggaggugcugguccugugggggauccaccaccccucgaccuccgcggaccagcagagccucuaccagaacgccgacacguacguguucgugggcuccucgcgguacuccaagaaguucaagccggagaucgccauccgccccaagguccgggaccaggagggccgcaugaacuacuacuggacccugguggagcccggggacaagaucaccuucgaggccaccggcaaccugguggucccccgguacgccuucgcgauggagcgcaacgccgggagcggcaucaucaucuccgacacgccggugcacgacugcaacacgaccugccagacccccaagggcgccaucaacaccucgcuccccuuccagaacauccaccccaucaccaucgggaagugcccgaaguacgugaaguccaccaagcugcggcuggccaccggccuccgcaacauccccagcauccagucccgggggcuguucggcgccaucgcgggguucaucgagggcggcuggacggggauggucgacggcugguacggguaccaccaccagaacgagcagggcagcggguacgccgccgaccugaaguccacccagaacgccaucgacgagaucaccaacaaggugaacucggugaucgagaagaugaacacccaguucacggccgucggcaaggaguucaaccaccucgagaagcgcaucgagaaccugaacaagaagguggacgacggcuuccuggacaucuggaccuacaacgcggagcuccugguccugcucgagaacgagcggacccuggacuaccacgacuccaacgugaagaaccuguacgagaaggugcgcagccagcucaagaacaacgccaaggagaucgggaacggcugcuucgaguucuaccacaagugcgacaacacgugcauggaguccgucaagaacgggaccuacgacuaccccaaguacucggaggaggccaagcugaaccgggaggagaucgacggcgugaagcuggaguccacccgcaucuaccagauccucgccaucuacagcaccguggccucgucccugguccugguggugagccucggggcgaucuccuucuggaugugcagcaacggcucccugcagugccggaucugcaucuga

SEQ ID NO: 5231 - RNA, 1701 nt, Artificial Sequence; identical to SEQ ID NO: 3156
  derived and/or modified CDS sequence (AUadapt) from InfluenzaA__ADH01808__HA

SEQ ID NO: 5232 - RNA, 1701 nt, Artificial Sequence
  derived and/or modified CDS sequence (AUadapt) from InfluenzaA__ADH01818__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucaucgugucccugggggccaucucguucuggaugugcuccaacggcagccugcagugccggaucugcaucuga

SEQ ID NO: 5233 - RNA, 1701 nt, Artificial Sequence; identical to SEQ ID NO: 3156
  derived and/or modified CDS sequence (AUadapt) from InfluenzaA__ADH01828__HA

SEQ ID NO: 5234 - RNA, 1701 nt, Artificial Sequence; identical to SEQ ID NO: 116
  derived and/or modified CDS sequence (AUadapt) from InfluenzaA__ADH01838__HA

SEQ ID NO: 5235 - RNA, 1701 nt, Artificial Sequence; identical to SEQ ID NO: 3156
  derived and/or modified CDS sequence (AUadapt) from InfluenzaA__ADH01848__HA

SEQ ID NO: 5236 - RNA, 1701 nt, Artificial Sequence; identical to SEQ ID NO: 3156
  derived and/or modified CDS sequence (AUadapt) from InfluenzaA__ADH01858__HA

SEQ ID NO: 5237 - RNA, 1701 nt, Artificial Sequence; identical to SEQ ID NO: 116
  derived and/or modified CDS sequence (AUadapt) from InfluenzaA__ADH01868__HA

SEQ ID NO: 5238 - RNA, 1701 nt, Artificial Sequence; identical to SEQ ID NO: 116
  derived and/or modified CDS sequence (AUadapt) from InfluenzaA__ADH01878__HA

SEQ ID NO: 5239 - RNA, 1701 nt, Artificial Sequence; identical to SEQ ID NO: 3156
  derived and/or modified CDS sequence (AUadapt) from InfluenzaA__ADH01888__HA

SEQ ID NO: 5240 - RNA, 1701 nt, Artificial Sequence; identical to SEQ ID NO: 116
  derived and/or modified CDS sequence (AUadapt) from InfluenzaA__ADH01898__HA

SEQ ID NO: 5241 - RNA, 1701 nt, Artificial Sequence; identical to SEQ ID NO: 3005
  derived and/or modified CDS sequence (AUadapt) from InfluenzaA__ADH01908__HA

SEQ ID NO: 5242 - RNA, 1701 nt, Artificial Sequence
  derived and/or modified CDS sequence (AUadapt) from InfluenzaA__ADH01918__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgagagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgccaaguccuucuacaagaaccugaucuggcucgugaagaaggggaacucguaccccaagcuguccaagagcuacaucaacgacaaggagaaggaggugcugguccucuggggcauccaccaccccucgaccuccgcggaccagcagagccuguaccagaacgccgacgccuacguguucguggggacgucccgguacucgaagaaguucaagcccgagaucgccauccgcccgaagguccgggaccaggagggccgcaugaacuacuacuggacccugguggagcccggcgacaagaucaccuucgaggccaccgggaaccucguggucccccgguacgcguucgccauggagcgcaacgccggcuccgggaucaucaucagcgacacgcccgugcacgacugcaacacgaccugccagaccccgaagggcgccaucaacaccucccugcccuuccagaacauccaccccaucaccaucggcaagugccccaaguacgucaagucgaccaagcugcggcucgccaccgggcugcgcaacgugccguccauccagagccggggccuguucggggcgaucgccggcuucaucgagggcggguggacgggcaugguggacgggugguacggcuaccaccaccagaacgagcagggguccggcuacgccgccgaccucaagucgacccagaacgccaucgacaagaucaccaacaaggugaacuccgucaucgagaagaugaacacccaguucacggcgguggggaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcucgagagcacccgcaucuaccagauccuggccaucuacuccaccgucgcgucgagccuggugcucguggucucccugggcgccaucucguucuggaugugcuccaacgggagccugcagugccggaucugcaucuga

SEQ ID NO: 5243 - RNA, 1701 nt, Artificial Sequence
  derived and/or modified CDS sequence (AUadapt) from InfluenzaA__ADH01928__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgccagcuccuucgagcgcuucgagaucuuccccaagaccucguccuggcccaaccacgacucgaacaagggggugaccgccgccugcccgcacgcgggcgccaaguccuucuacaagaaccugaucuggcucgucaagaaggggaacagcuaccccaagcuguccaagucguacaucaacgacaagggcaaggaggugcuggugcucugggggauccaccaccccagcaccuccgccgaccagcagucgcuguaccagaacgccgacgccuacgucuucgugggcacgucccgguacagcaagaaguucaagcccgagaucgcgauccgcccgaaggugcgggaccaggagggccgcaugaacuacuacuggacccuggucgagcccggggacaagaucaccuucgaggccaccggcaaccucguggugccccgguacgccuucgccauggagcgcaacgccggguccggcaucaucaucucggacacgcccguccacgacugcaacacgaccugccagaccccgaagggcgcgaucaacaccucccugcccuuccagaacauccaccccaucaccaucgggaagugccccaaguacgucaagagcaccaagcugcggcucgccaccggccugcgcaacaucccguccauccagucgcgggggcuguucggcgccaucgccggguucaucgagggcggcuggacggggaugguggacggcugguacggguaccaccaccagaacgagcagggcuccggguacgccgcggaccucaagucgacccagaacgccaucgacgagaucaccaacaaggugaacuccgugaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagucggugaagaacgggaccuacgacuaccccaaguacuccgaggaggcgaagcugaaccgggaggagaucgacggcgucaagcucgagagcacccgcaucuaccagauccuggccaucuacuccaccguggccucgagccuggugcucgucgugucccugggggccaucucguucuggaugugcuccaacggcagccugcagugccggaucugcaucuga

SEQ ID NO: 5244 - RNA, 1701 nt, Artificial Sequence
  derived and/or modified CDS sequence (AUadapt) from InfluenzaA__ADH01938__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacaagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 5245 - RNA, 1701 nt, Artificial Sequence; identical to SEQ ID NO: 4078
  derived and/or modified CDS sequence (AUadapt) from InfluenzaA__ADH01948__HA

SEQ ID NO: 5246 - RNA, 1701 nt, Artificial Sequence
  derived and/or modified CDS sequence (AUadapt) from InfluenzaA__ADH01958__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaacugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucaucgugucccugggggccaucucguucuggaugugcuccaacggcagccugcagugccggaucugcaucuga

SEQ ID NO: 5247 - RNA, 1701 nt, Artificial Sequence
  derived and/or modified CDS sequence (AUadapt) from InfluenzaA__ADH01968__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagucgcuguaccagaacgccgacgccuacguguucgugggcacgucccgguacagcaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 5248 - RNA, 1701 nt, Artificial Sequence; identical to SEQ ID NO: 4078
  derived and/or modified CDS sequence (AUadapt) from InfluenzaA__ADH01978__HA

SEQ ID NO: 5249 - RNA, 1701 nt, Artificial Sequence; identical to SEQ ID NO: 4078
  derived and/or modified CDS sequence (AUadapt) from InfluenzaA__ADH01988__HA

SEQ ID NO: 5250 - RNA, 1701 nt, Artificial Sequence; identical to SEQ ID NO: 5081
  derived and/or modified CDS sequence (AUadapt) from InfluenzaA__ADH01998__HA

SEQ ID NO: 5251 - RNA, 1701 nt, Artificial Sequence
  derived and/or modified CDS sequence (AUadapt) from InfluenzaA__ADH02008__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggggaagcacaacggcaagcucugcaagcugcgcggggucgcgccccugcaccucggcaagugcaacaucgccggguggauccugggcaacccggagugcgagucgcuguccaccgccagcuccuggucguacaucguggagaccuccagcuccgacaacggcacgugcuaccccggggacuucaucgacuacgaggagcuccgggagcagcugucguccgugagcuccuucgagcgcuucgagaucuuccccaagaccucguccuggcccaaccacgacagcaacaagggcgucaccgccgccugcccgcacgccggggcgaaguccuucuacaagaaccugaucuggcucaucaagaagggcaacucguaccccaagcuguccaagagcuacaucaacgacaaggagaaggaggugcuggugcucugggggauccaccaccccucgaccuccgccgaccagcagagccuguaccagaacgccgacgccuacgucuucgugggcacgucccgguacucgaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacaucccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgugaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgucaagcucgagagcacccgcaucuaccagauccuggcgaucuacuccaccguggccucgagccuggugcucgucgugucccugggggccaucucguucuggaugugcuccaacggcagccugcagugccggaucugcaucuga

SEQ ID NO: 5252 - RNA, 1701 nt, Artificial Sequence; identical to SEQ ID NO: 4078
  derived and/or modified CDS sequence (AUadapt) from InfluenzaA__ADI24508__HA

SEQ ID NO: 5253 - RNA, 1701 nt, Artificial Sequence
  derived and/or modified CDS sequence (AUadapt) from InfluenzaA__ADI24515__HA
augaaggccauccuggugguccuccuguacaccuucgccaccgcgaacgccgacacgcugugcgugggcuaccacgccaacaacucgaccgacaccguggacaccguccucgagaagaacgugacggugacccacuccgucaaccugcuggaggacaagcacaacgggaagcucugcaagcugcgcggcguggcgccccugcaccucgggaagugcaacaucgccggcuggauccuggggaacccggagugcgagucgcugcccaccgcguccagcugguccuacaucguggagaccucguccagcgacaacggcacgugcuaccccggcgacuucaucgacuacgaggagcuccgggagcagcuguccucggucuccagcuucgagcgcuucgagaucuuccccaagaccuccucguggccgaaccacgacuccaacaagggggugaccgccgccugcccccacgccggcgccaagucguucuacaagaaccugaucuggcucgugaagaaggggaacuccuaccccaagcugagcaaguccuacaucaacgacaagggcaaggagguccuggugcucugggggauccaccaccccucgaccagcgccgaccagcagucccuguaccagaacgccgacgccuacguguucgucggcacgucgcgguacuccaagaaguucaagccggagaucgccauccgccccaaggugcgggaccaggagggccgcaugaacuacuacuggacccugguggagcccggggacaagaucaccuucgaggcgaccggcaaccucgucgugccccgguacgccuucgccauggagcgcaacgccgggagcggcaucaucaucuccgacacgccggugcacgacugcaacacgaccugccagacccccaagggcgccaucaacaccucgcugcccuuccagaacauccaccccaucaccaucgggaagugcccgaaguacgucaaguccaccaagcugcggcucgcgaccggccugcgcaacgugcccagcauccagucccgggggcuguucggcgccaucgccggguucaucgagggcggcuggacggggaugguggacggcugguacggguaccaccaccagaacgagcagggcucgggguacgccgccgaccucaaguccacccagaacgcgaucgacaagucgaccaacaaggucaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgucaagcucgagagcacccgcaucuaccagauccuggcgaucuacuccaccguggccucgagccuggugcucgucgugucccugggggccaucucguucuggaugugcuccaacggcagccugcagugccggaucugcaucuga

SEQ ID NO: 5254 - RNA, 1701 nt, Artificial Sequence; identical to SEQ ID NO: 4078
  derived and/or modified CDS sequence (AUadapt) from InfluenzaA__ADI24517__HA

SEQ ID NO: 5255 - RNA, 1701 nt, Artificial Sequence; identical to SEQ ID NO: 4078
  derived and/or modified CDS sequence (AUadapt) from InfluenzaA__ADI24519__HA

SEQ ID NO: 5256 - RNA, 1701 nt, Artificial Sequence; identical to SEQ ID NO: 4078
  derived and/or modified CDS sequence (AUadapt) from InfluenzaA__ADI24521__HA

SEQ ID NO: 5257 - RNA, 1701 nt, Artificial Sequence; identical to SEQ ID NO: 4466
  derived and/or modified CDS sequence (AUadapt) from InfluenzaA__ADI24523__HA

SEQ ID NO: 5258 - RNA, 1701 nt, Artificial Sequence
  derived and/or modified CDS sequence (AUadapt) from InfluenzaA__ADI24525__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcgagcugcgcggcgucgcgccccugcaccucgggaagugcaacaucgccggcuggauccuggggaacccggagugcgagucgcuguccaccgcgcggagcugguccuacaucguggagaccucguccagcgacaacggcacgugcuaccccggcgacuucaucgacuacgaggagcuccgcgagcagcuguccucgguguccagcuucgagcgguucgagaucuuccccaagaccuccucguggcccaaccacgacuccaacaagggggucaccgccgccugcccgcacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacguguucgugggcacgucgcgcuacuccaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccgggagcggcaucaucaucuccgacacgcccgugcacgacugcaacacgaccugccagaccccgaagggcgccaucaacaccucgcugcccuuccagaacauccaccccaucaccaucgggaagugccccaaguacgugaaguccaccaagcugcgccucgcgaccggccugcggaacgucccgagcauccagucccgcgggcuguucggcgccaucgccggguucaucgagggcggcuggacggggaugguggacggcugguacggguaccaccaccagaacgagcagggcucgggguacgccgccgaccucaaguccacccagaacgcgaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaacgugaagaaccucuacgagaaggucaagucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 5259 - RNA, 1701 nt, Artificial Sequence; identical to SEQ ID NO: 4078
  derived and/or modified CDS sequence (AUadapt) from InfluenzaA__ADI24527__HA

SEQ ID NO: 5260 - RNA, 1701 nt, Artificial Sequence; identical to SEQ ID NO: 4466
  derived and/or modified CDS sequence (AUadapt) from InfluenzaA__ADI24529__HA

SEQ ID NO: 5261 - RNA, 1701 nt, Artificial Sequence
  derived and/or modified CDS sequence (AUadapt) from InfluenzaA__ADI24531__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcugcucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccuggacaucuggaccuacaacgccgagcugcucgugcugcuggagaacgagcggacccucgacuaccacgacagcaacgugaagaaccuguacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcucaaccgggaggagaucgacggcgugaagcuggagagcacccgcaucuaccagauccuggcgaucuacuccaccgucgccucgagccucgugcugguggucucccugggggccaucucguucuggaugugcuccaacggcagccuccagugcaagaucugcaucuga

SEQ ID NO: 5262 - RNA, 1701 nt, Artificial Sequence
  derived and/or modified CDS sequence (AUadapt) from InfluenzaA__ADI24536__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcgacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaagaucgacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgagccugguccucguggugucccugggggccaucucguucuggaugugcuccaacggcagccugcagugccggaucugcaucuga

SEQ ID NO: 5263 - RNA, 1701 nt, Artificial Sequence; identical to SEQ ID NO: 4078
  derived and/or modified CDS sequence (AUadapt) from InfluenzaA__ADI24546__HA

SEQ ID NO: 5264 - RNA, 1701 nt, Artificial Sequence; identical to SEQ ID NO: 4078
  derived and/or modified CDS sequence (AUadapt) from InfluenzaA__ADI24553__HA

SEQ ID NO: 5265 - RNA, 1701 nt, Artificial Sequence; identical to SEQ ID NO: 4078
  derived and/or modified CDS sequence (AUadapt) from InfluenzaA__ADI24555__HA

SEQ ID NO: 5266 - RNA, 1701 nt, Artificial Sequence
  derived and/or modified CDS sequence (AUadapt) from InfluenzaA__ADI24557__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggagauccuggugcucugggggauccaccaccccucgaccuccgccgaccagcagagccuguaccagaacgccgacgccuacgucuucgugggcacgucccgguacucgaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgagccugguccucguggugucccugggggccaucucguucuggaugugcuccaacggcagccugcagugccggaucugcaucuga

SEQ ID NO: 5267 - RNA, 1701 nt, Artificial Sequence; identical to SEQ ID NO: 4078
  derived and/or modified CDS sequence (AUadapt) from InfluenzaA__ADI24559__HA

SEQ ID NO: 5268 - RNA, 1701 nt, Artificial Sequence
  derived and/or modified CDS sequence (AUadapt) from InfluenzaA__ADI24561__HA
augaaggccauccuggugauccuccuguacaccuucgccaccgcgaacgccgacacgcugugcaucggcuaccacgccaacaacucgaccgacaccgucgacaccgugcucgagaagaacgugacggucacccacuccgugaaccugcuggaggacaagcacgacgggaagcucugcaagcugcgcggcguggcgccccugcaccucgggaagugcaacaucgccggcuggauccuggggaacccggagugcgagucgcuguccaccgccagcuccuggucguacaucgucgagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggugaccgccgccugcccgcacgccggcgcgaaguccuucuacaagaaccugaucuggcucgucaagaaggggaacucguaccccaagcuguccaagagcuacaucaacgacaagggcaaggaggugcuggugcucugggggauccaccaccccucgaccuccgccgaccagcagagccuguaccagaacgccgacgccuacgucuucgugggcacgucccgguacucgaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgagccugguccucguggugucccugggggccaucucguucuggaugugcuccaacggcagccugcagugccggaucugcaucuga

SEQ ID NO: 5269 - RNA, 1701 nt, Artificial Sequence; identical to SEQ ID NO: 4078
  derived and/or modified CDS sequence (AUadapt) from InfluenzaA__ADI24563__HA

SEQ ID NO: 5270 - RNA, 1701 nt, Artificial Sequence
  derived and/or modified CDS sequence (AUadapt) from InfluenzaA__ADI24565__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacgacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaagaaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 5271 - RNA, 1701 nt, Artificial Sequence; identical to SEQ ID NO: 4078
  derived and/or modified CDS sequence (AUadapt) from InfluenzaA__ADI24567__HA

SEQ ID NO: 5272 - RNA, 1701 nt, Artificial Sequence
  derived and/or modified CDS sequence (AUadapt) from InfluenzaA__ADI24569__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccaucgagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 5273 - RNA, 1701 nt, Artificial Sequence; identical to SEQ ID NO: 4078
  derived and/or modified CDS sequence (AUadapt) from InfluenzaA__ADI24571__HA

SEQ ID NO: 5274 - RNA, 1701 nt, Artificial Sequence; identical to SEQ ID NO: 4466
  derived and/or modified CDS sequence (AUadapt) from InfluenzaA__ADI24573__HA

SEQ ID NO: 5275 - RNA, 1701 nt, Artificial Sequence
  derived and/or modified CDS sequence (AUadapt) from InfluenzaA__ADI24575__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacguggagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 5276 - RNA, 1701 nt, Artificial Sequence; identical to SEQ ID NO: 4078
  derived and/or modified CDS sequence (AUadapt) from InfluenzaA__ADI24577__HA

SEQ ID NO: 5277 - RNA, 1701 nt, Artificial Sequence
  derived and/or modified CDS sequence (AUadapt) from InfluenzaA__ADI24581__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcugggugcuggggaacccggagugcgagucgcuguccaccgccagcuccuggucguacaucguggagaccuccagcuccgacaacggcacgugcuaccccggcgacuucaucgacuacgaggagcuccgggagcagcugucguccgucagcuccuucgagcgcuucgagaucuuccccaagaccucguccuggcccaaccacgacagcaacaagggggugaccgccgccugcccgcacgccggcgcgaaguccuucuacaagaaccugaucuggcucgugaagaaggggaacucguaccccaagcuguccaagagcuacaucaacgacaagggcaaggagguccuggugcucugggggauccaccaccccucgaccuccgccgaccagcagagccuguaccagaacgccgacgccuacguguucgucggcacgucccgguacucgaagaaguucaagcccgagaucgccauccgcccgaaggugcgggaccaggagggccgcaugaacuacuacuggacccugguggagcccggggacaagaucaccuucgaggcgaccggcaaccucgucgugccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggucaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgucaagcucgagagcacccgcaucuaccagauccuggcgaucuacuccaccguggccucgagccuggugcucgucgugucccugggggccaucucguucuggaugugcuccaacggcagccugcagugccggaucugcaucuga

SEQ ID NO: 5278 - RNA, 1701 nt, Artificial Sequence
  derived and/or modified CDS sequence (AUadapt) from InfluenzaA__ADI24583__HA
augaaggccauccuggugguccuccuguacaccuucgccaccgcgaacgccgacacgcugugcaucggcuaccacgccaacaacucgaccgacaccguggacaccauccucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagucgcuguccaccgccagcuccuggucguacaucgucgagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggugaccgccgccugcccgcacgccggcgcgaaguccuucuacaagaaccugaucuggcucgucaagaaggggaacucguaccccaagcuguccaagagcuacaucaacgacaagggcaaggaggugcuggugcucugggggauccaccaccccucgaccuccgccgaccagcagagccuguaccagaacgccgacgccuacgucuucgugggcacgucccgguacucgaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgagccugguccucguggugucccugggggccaucucguucuggaugugcuccaacggcagccugcagugccggaucugcaucuga

SEQ ID NO: 5279 - RNA, 1701 nt, Artificial Sequence
  derived and/or modified CDS sequence (AUadapt) from InfluenzaA__ADI24590__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgccaaccugcuggaggacaagcacaacgggaagcucugcaagcugcgcggcguggcgccccugcaccucgggaagugcaacaucgccggcuggauccuggggaacccggagugcgagucgcuguccaccgccagcuccuggucguacaucgucgagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggugaccgccgccugcccgcacgcgggcgccaaguccuucuacaagaaccugaucuggcucgucaagaaggggaacagcuaccccaagcuguccaagucguacaucaacgacaagggcaaggaggugcuggugcucugggggauccaccaccccagcaccuccgccgaccagcagucgcuguaccagaacgccgacgccuacgucuucgugggcacgucccgguacagcaagaaguucaagcccgagaucgcgauccgcccgaaggugcgggaccaggagggccgcaugaacuacuacuggacccuggucgagcccggggacaagaucaccuucgaggccaccggcaaccucguggugccccgguacgccuucgccauggagcgcaacgccggguccggcaucaucaucucggacacgcccguccacgacugcaacacgaccugccagaccccgaagggcgcgaucaacaccucccugcccuuccagaacauccaccccaucaccaucgggaagugccccaaguacgucaagagcaccaagcugcggcucgccaccggccugcgcaacgugccguccauccagucgcgggggcuguucggcgccaucgccggguucaucgagggcggcuggacggggaugguggacggcugguacggguaccaccaccagaacgagcagggcuccggguacgccgcggaccucaagucgacccagaacgccaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggcgaagcugaaccgggaggagaucgacggcgugaagcucgagagcacccgcaucuaccagauccuggccaucuacuccaccguggccucgagccugguccucguggugucccugggggccaucucguucuggaugugcuccaacggcagccugcagugccggaucugcaucuga

SEQ ID NO: 5280 - RNA, 1701 nt, Artificial Sequence
  derived and/or modified CDS sequence (AUadapt) from InfluenzaA__ADI24597__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgccaaccugcuggaggacaagcacaacgggaagcucugcaagcugcgcggcguggcgccccugcaccucgggaacugcaacaucgccggcuggauccuggggaacccggagugcgagucgcuguccaccgccagcuccuggucguacaucgucgagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggugaccgccgccugcccgcacgcgggcgccaaguccuucuacaagaaccugaucuggcucgucaagaaggggaacagcuaccccaagcuguccaagucguacaucaacgacaagggcaaggaggugcuggugcucugggggauccaccaccccagcaccuccgccgaccagcagucgcuguaccagaacgccgacgccuacgucuucgugggcacgucccgguacagcaagaaguucaagcccgagaucgcgauccgcccgaaggugcgggaccaggagggccgcaugaacuacuacuggacccuggucgagcccggggacaagaucaccuucgaggccaccggcaaccucguggugccccgguacgccuucgccauggagcgcaacgccggguccggcaucaucaucucggacacgcccguccacgacugcaacacgaccugccagaccccgaagggcgcgaucaacaccucccugcccuuccagaacauccaccccaucaccaucgggaagugccccaaguacgucaagagcaccaagcugcggcucgccaccggccugcgcaacgugccguccauccagucgcgggggcuguucggcgccaucgccggguucaucgagggcggcuggacggggaugguggacggcugguacggguaccaccaccagaacgagcagggcuccggguacgccgcggaccucaagucgacccagaacgccaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggcgaagcugaaccgggaggagaucgacggcgugaagcucgagagcacccgcaucuaccagauccuggccaucuacuccaccguggccucgagccugguccucguggugucccugggggccaucucguucuggaugugcuccaacggcagccugcagugccggaucugcaucuga

SEQ ID NO: 5281 - RNA, 1701 nt, Artificial Sequence; identical to SEQ ID NO: 5279
  derived and/or modified CDS sequence (AUadapt) from InfluenzaA__ADI24612__HA

SEQ ID NO: 5282 - RNA, 1701 nt, Artificial Sequence
  derived and/or modified CDS sequence (AUadapt) from InfluenzaA__ADI24619__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgccaaccugcuggaggacaagcacaacgggaagcucugcaagcugcgcggcguggcgccccugcaccucgggaagugcaacaucgccggcuggauccuggggaacccggagugcgagucgcuguccaccgccagcuccuggucguacaucgucgagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggugaccgccgccugcccgcacgcgggcgccaaguccuucuacaagaaccugaucuggcucgucaagaaggggaacucguaccccaagcuguccaagagcuacaucaacgacaagggcaaggaggugcuggugcucugggggauccaccaccccucgaccuccgucgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 5283 - RNA, 1701 nt, Artificial Sequence
  derived and/or modified CDS sequence (AUadapt) from InfluenzaA__ADI24621__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcaccaucaacaccucccugcccuuccagaacauccaccccaucaccaucgggaagugccccaaguacgucaagucgaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacaagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggccaucuacuccaccgucgcgucgagccuggugcucaucgugucccugggggccaucucguucuggaugugcuccaacggcagccugcagugccggaucugcaucuga

SEQ ID NO: 5284 - RNA, 1701 nt, Artificial Sequence
  derived and/or modified CDS sequence (AUadapt) from InfluenzaA__ADI48184__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggggcgcaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagucgaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagcgcguccggucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgcgaggagaucgacggggugaagcucgagagcacccggaucuaccagauccuggcgaucuacuccaccgucgccucgagccuggugcucguggucucccugggcgccaucucguucuggaugugcuccaacggcagccugcagugccgcaucugcaucuga

SEQ ID NO: 5285 - RNA, 1701 nt, Artificial Sequence; identical to SEQ ID NO: 4078
  derived and/or modified CDS sequence (AUadapt) from InfluenzaA__ADI48186__HA

SEQ ID NO: 5286 - RNA, 1701 nt, Artificial Sequence
  derived and/or modified CDS sequence (AUadapt) from InfluenzaA__ADI48188__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccgacaucaucaucagcgacacgcccgugcacgacugcaacacgaccugccagaccccgaagggcgccaucaacaccucccugcccuuccagaacauccaccccaucaccaucggcaagugccccaaguacgucaagucgaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagucgacccagaacgcgaucgacaagaucaccaacaaggugaacuccgucaucgagaagaugaacacccaguucacggccguggggaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcucgagagcacccgcaucuaccagauccuggcgaucuacuccaccgucgccucgagccuggugcucguggucucccugggcgccaucucguucuggaugugcuccaacgggagccugcagugccggaucugcaucuga

SEQ ID NO: 5287 - RNA, 1701 nt, Artificial Sequence
  derived and/or modified CDS sequence (AUadapt) from InfluenzaA__ADI48190__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcaccaagaucuaccagauccuggcgaucuacuccaccgucgccucgagccuggugcucguggucucccugggggccaucucguucuggaugugcuccaacggcagccugcagugccgcaucugcaucuga

SEQ ID NO: 5288 - RNA, 1701 nt, Artificial Sequence
  derived and/or modified CDS sequence (AUadapt) from InfluenzaA__ADI48192__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccugaccaucuacuccaccgucgcgucgagccuggugcucguggucucccugggggccaucucguucuggaugugcuccaacggcagccugcagugccggaucugcaucuga

SEQ ID NO: 5289 - RNA, 1701 nt, Artificial Sequence
  derived and/or modified CDS sequence (AUadapt) from InfluenzaA__ADI48194__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucgcugguguccagcuucgagcgcuucgagaucuuccccaagaccaacuccuggcccaaccacgacucgaacaagggggucaccgccgccugcccgcacgccggcgcgaaguccuucuacaagaaccucaucuggcuggugaagaaggggaacagcuaccccaagcuguccaagucguacaucaacgacaagggcaaggaggugcucguccugugggggauccaccaccccuccaccagcgccgaccagcagucgcuguaccagaacgccgacgccuacguguucgugggcacgucccgguacucgaagaaguucaagcccgagaucgccauccgcccgaagguccgggaccaggagggccgcaugaacuacuacuggacccucguggagcccggggacaagaucaccuucgaggcgaccggcaaccugguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcuccggcuggcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacagcaacgugaagaaccuguacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcucaaccgggaggagaucgacggcgugaagcuggagagcacccgcaucuaccagauccuggcgaucuacuccaccgucgccucgucccucgugcugguggucagccugggggccaucucguucuggaugugcuccaacggcagccuccagugccggaucugcaucuga

SEQ ID NO: 5290 - RNA, 1701 nt, Artificial Sequence
  derived and/or modified CDS sequence (AUadapt) from InfluenzaA__ADI48196__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgacagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 5291 - RNA, 1701 nt, Artificial Sequence; identical to SEQ ID NO: 4078
  derived and/or modified CDS sequence (AUadapt) from InfluenzaA__ADI48198__HA

SEQ ID NO: 5292 - RNA, 1701 nt, Artificial Sequence; identical to SEQ ID NO: 4078
  derived and/or modified CDS sequence (AUadapt) from InfluenzaA__ADI48200__HA

SEQ ID NO: 5293 - RNA, 1701 nt, Artificial Sequence
  derived and/or modified CDS sequence (AUadapt) from InfluenzaA__ADI48202__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaucagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcaccucccgguacagcaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccggguccggcaucaucaucucggacacccccgugcacgacugcaacacgaccugccagaccccgaagggcgccaucaacaccucccugcccuuccagaacauccaccccaucacgaucgggaagugccccaaguacgucaagagcaccaagcugcggcucgcgaccggccugcgcaacgugccguccauccagucgcgggggcuguucggcgccaucgccggguucaucgagggcggcuggaccgggaugguggacggcugguacggguaccaccaccagaacgagcagggcuccggguacgccgccgaccucaagagcacgcagaacgcgaucgacaagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgacccgcaucuaccagauccuggcgaucuacuccaccgucgccagcucgcuggugcucguggucucccugggggccaucagcuucuggaugugcuccaacggcagccugcagugccggaucugcaucuga

SEQ ID NO: 5294 - RNA, 1701 nt, Artificial Sequence
  derived and/or modified CDS sequence (AUadapt) from InfluenzaA__ADI48204__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacguggacgccuacguguucgucggcacgucccgguacagcaagaaguucaagcccgagaucgccauccgcccgaaggugcgggaccaggagggccgcaugaacuacuacuggacccugguggagcccggggacaagaucaccuucgaggccaccggcaaccucgucgugccccgguacgcguucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgccaccggccugcgcaacgugccguccauccagucgcgggggcuguucggcgcgaucgccggguucaucgagggcggcuggacggggaugguggacggcugguacggguaccaccaccagaacgagcagggcuccggguacgccgccgaccucaagagcacccagaacgccaucgacaagaucaccaagaaggucaacuccgugaucgagaagaugaacacccaguucacggcggucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacucgaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagucgacccgcaucuaccagauccuggccaucuacuccaccguggcgagcucgcuggugcucgucgugucccugggggccaucagcuucuggaugugcuccaacggcagccugcagugccggaucugcaucuga

SEQ ID NO: 5295 - RNA, 1701 nt, Artificial Sequence; identical to SEQ ID NO: 4078
  derived and/or modified CDS sequence (AUadapt) from InfluenzaA__ADI48208__HA

SEQ ID NO: 5296 - RNA, 1701 nt, Artificial Sequence; identical to SEQ ID NO: 4078
  derived and/or modified CDS sequence (AUadapt) from InfluenzaA__ADI48210__HA

SEQ ID NO: 5297 - RNA, 1701 nt, Artificial Sequence
  derived and/or modified CDS sequence (AUadapt) from InfluenzaA__ADI48212__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacguguggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgucaagcucgagagcacccgcaucuaccagauccuggcgaucuacuccaccguggccucgagccuggugcucgucgugucccugggggccaucucguucuggaugugcuccaacggcagccugcagugccggaucugcaucuga

SEQ ID NO: 5298 - RNA, 1701 nt, Artificial Sequence
  derived and/or modified CDS sequence (AUadapt) from InfluenzaA__ADI48214__HA
augaaggccauccuggugguccuccuguacaccuucgccaucgcgaacgccgacacccugugcaucggcuaccacgccaacaacucgacggacaccguggacaccgugcucgagaagaacgucaccgugacgcacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacgggaccugcuaccccggcgacuucaucgacuacgaggagcuccgggagcagcugucguccgugagcuccuucgagcgcuucgagaucuuccccaagacgucguccuggcccaaccacgacagcaacaagggcgucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcaccucccgguacucgaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucacgaucgggaagugccccaaguacgucaagucgaccaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagucgacgcagaacgcgaucgacaagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucgccgugucccugggggccaucucguucuggaugugcuccaacggcagccugcagugccggaucugcaucuga

SEQ ID NO: 5299 - RNA, 1701 nt, Artificial Sequence; identical to SEQ ID NO: 5297
  derived and/or modified CDS sequence (AUadapt) from InfluenzaA__ADI48216__HA

SEQ ID NO: 5300 - RNA, 1701 nt, Artificial Sequence
  derived and/or modified CDS sequence (AUadapt) from InfluenzaA__ADI48218__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccaggacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 5301 - RNA, 1701 nt, Artificial Sequence
  derived and/or modified CDS sequence (AUadapt) from InfluenzaA__ADI48220__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgagaccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacaagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccugggguaccacgacagcaacgugaagaaccucuacgagaagguccgcucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcucgagagcacccgcaucuaccagauccuggccaucuacuccaccgucgcgucgagccuggugcucguggucucccugggcgccaucucguucuggaugugcuccaacggcagccugcagugccggaucugcaucuga

SEQ ID NO: 5302 - RNA, 1701 nt, Artificial Sequence
  derived and/or modified CDS sequence (AUadapt) from InfluenzaA__ADI48622__HA
augaaggccauccugguguuccuccuguacaccuucgccaccgcgaacgccgacacgcugugcaucggcuaccacgccaacaacucgaccgacaccgucgacaccgugcucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagagccuguccaccgccucguccuggagcuacaucgucgagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggugaccgccgccugcccgcacgccggcgcgaaguccuucuacaagaaccugaucuggcucgucaagaaggggaacagcuaccccaagcuguccaagucguacaucaacgacaagggcaaggaggugcuggugcucugggggauccaccaccccagcaccuccgccgaccagcagucgcuguaccagaacgccgacgccuacgucuucgugggcacgucccgguacagcaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucucggacacgcccguccacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacucgaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagucgacccgcaucuaccagauccuggcgaucuacuccaccguggccagcucgcugguccucguggugucccugggggccaucagcuucuggaugugcuccaacggcagccugcagugccggaucugcaucuga

SEQ ID NO: 5303 - RNA, 1701 nt, Artificial Sequence
  derived and/or modified CDS sequence (AUadapt) from InfluenzaA__ADI48632__HA
auggaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucuggggcgugcaccaccccagcaccuccgccgaccagcagucgcuguaccagaacgccgacgccuacguguucgucggguccagccgguacuccaagaaguucaagcccgagaucgccauccgcccgaaggugcgggaccaggagggccgcaugaacuacuacuggacgcugguggagcccggggacaagaucaccuucgaggcgaccggcaaccucgucgugccccgguacgccuucgccauggagcgcaacgccgggucgggcaucaucaucuccgacacccccgugcacgacugcaacacgaccugccagaccccgaagggcgccaucaacaccagccugcccuuccacaacauccaccccaucacgaucgggaagugccccaaguacgucaaguccaccaagcugcggcucgcgaccggccugcgcaacgugccgucgauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggucaacucggugaucgagaagaugaacacccaguucaccgccgucggcaaggaguucaaccaccuggagaagcgcaucgagaaccugaacaagaagguggacgacggcuuccucgacaucuggacguacaacgccgagcugcuggugcuccuggagaacgagcggacccuggacuaccacgacuccaacgucaagaaccucuacgagaaggugcgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgucaagcucgaguccacccgcaucuaccagauccuggcgaucuacagcaccguggccucgucccuggugcucgucgugagccugggggccaucuccuucuggaugugcagcaacggcucccugcagugccggaucugcaucuga

SEQ ID NO: 5304 - RNA, 1701 nt, Artificial Sequence; identical to SEQ ID NO: 3156
  derived and/or modified CDS sequence (AUadapt) from InfluenzaA__ADI48642__HA

SEQ ID NO: 5305 - RNA, 1701 nt, Artificial Sequence; identical to SEQ ID NO: 3156
  derived and/or modified CDS sequence (AUadapt) from InfluenzaA__ADI48652__HA

SEQ ID NO: 5306 - RNA, 1701 nt, Artificial Sequence
  derived and/or modified CDS sequence (AUadapt) from InfluenzaA__ADI48672__HA
auggaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaacaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccacaacauccaccccaucacgaucgggaagugccccaaguacgugaaguccaccaagcugcggcucgcgaccggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 5307 - RNA, 1701 nt, Artificial Sequence; identical to SEQ ID NO: 116
  derived and/or modified CDS sequence (AUadapt) from InfluenzaA__ADI48682__HA

SEQ ID NO: 5308 - RNA, 1701 nt, Artificial Sequence; identical to SEQ ID NO: 3156
  derived and/or modified CDS sequence (AUadapt) from InfluenzaA__ADI48692__HA

SEQ ID NO: 5309 - RNA, 1701 nt, Artificial Sequence; identical to SEQ ID NO: 96
  derived and/or modified CDS sequence (AUadapt) from InfluenzaA__ADI48702__HA

SEQ ID NO: 5310 - RNA, 1701 nt, Artificial Sequence; identical to SEQ ID NO: 3156
  derived and/or modified CDS sequence (AUadapt) from InfluenzaA__ADI48712__HA

SEQ ID NO: 5311 - RNA, 1701 nt, Artificial Sequence; identical to SEQ ID NO: 3156
  derived and/or modified CDS sequence (AUadapt) from InfluenzaA__ADI48722__HA

SEQ ID NO: 5312 - RNA, 1701 nt, Artificial Sequence; identical to SEQ ID NO: 116
  derived and/or modified CDS sequence (AUadapt) from InfluenzaA__ADI48732__HA

SEQ ID NO: 5313 - RNA, 1701 nt, Artificial Sequence; identical to SEQ ID NO: 116
  derived and/or modified CDS sequence (AUadapt) from InfluenzaA__ADI48742__HA

SEQ ID NO: 5314 - RNA, 1701 nt, Artificial Sequence
  derived and/or modified CDS sequence (AUadapt) from InfluenzaA__ADI48752__HA
auggaggccauccugguguuccuccuguacaccuucgccaccgcgaacgccgacacgcugugcaucggcuaccacgccaacaacucgaccgacaccgucgacaccgugcucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagagccuguccaccgccucguccuggagcuacaucgucgagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacagcaacaaggggaucaccgccgccugcccgcacgccggcgcgaaguccuucuacaagaaccugaucuggcucgugaagaaggggaacucguaccccaagcuguccaagagcuacaucaacgacaagggcaaggagguccuggugcucugggggauccaccaccccucgaccuccgccgaccagcagagccuguaccagaacgccgacgccuacguguucgucggcuccucgcgguacuccaagaaguucaagcccgagaucgccauccgcccgaaggugcgggaccaggagggccgcaugaacuacuacuggacgcugguggagcccggggacaagaucaccuucgaggcgaccggcaaccucgucgugccccgguacgccuucgccauggagcgcaacgccgggagcggcaucaucaucuccgacacccccgugcacgacugcaacacgaccugccagaccccgaagggcgccaucaacaccucgcugcccuuccacaacauccaccccaucacgaucgggaagugccccaaguacgucaaguccaccaagcugcggcucgcgaccggccugcgcaacgugccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggucaacucggugaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgucaagaaccucuacgagaaggugcgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgucaagcucgaguccacccgcaucuaccagauccuggcgaucuacagcaccguggccucgucccuggugcucgucgugagccugggggccaucuccuucuggaugugcagcaacggcucccugcagugccggaucugcaucuga

SEQ ID NO: 5315 - RNA, 1701 nt, Artificial Sequence; identical to SEQ ID NO: 3156
  derived and/or modified CDS sequence (AUadapt) from InfluenzaA__ADI48762__HA

SEQ ID NO: 5316 - RNA, 1701 nt, Artificial Sequence
  derived and/or modified CDS sequence (AUadapt) from InfluenzaA__ADI48772__HA
auggaggccauccuggugguccuccuguacaccuucgccaccgcgaacgccgacacgcugugcaucggcuaccaggccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccacaacauccaccccaucacgaucgggaagugccccaaguacgugaaguccaccaagcugcggcucgcgaccggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 5317 - RNA, 1701 nt, Artificial Sequence
  derived and/or modified CDS sequence (AUadapt) from InfluenzaA__ADI48782__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggagucgaagcugaaccgggaggagaucgacggcgugaagcucgaguccacccgcaucuaccagauccuggccaucuacagcaccgucgcgucgucccuggugcucguggucagccugggggccaucuccuucuggaugugcagcaacggcucccugcagugccggaucugcaucuga

SEQ ID NO: 5318 - RNA, 1701 nt, Artificial Sequence
  derived and/or modified CDS sequence (AUadapt) from InfluenzaA__ADI48792__HA
auggaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacaucuucgugggcuccagccgguacuccaagaaguucaagcccgagaucgccauccgcccgaaggugcgggaccaggagggccgcaugaacuacuacuggacgcuggucgagcccggggacaagaucaccuucgaggcgaccggcaaccucguggugccccgguacgccuucgccauggagcgcaacgccgggucgggcaucaucaucuccgacacccccguccacgacugcaacacgaccugccagaccccgaagggcgccaucaacaccagccugcccuuccacaacauccaccccaucacgaucgggaagugccccaaguacgugaaguccaccaagcugcggcucgcgaccggccugcgcaacgugccgucgauccagucccgggggcuguucggcgccaucgccggguucaucgagggcggcuggaccgggauggucgacggcugguacggguaccaccaccagaacgagcagggcagcggguacgccgccgaccucaaguccacgcagaacgcgaucgacgagaucaccaacaaggugaacucggugaucgagaagaugaacacccaguucaccgccgucggcaaggaguucaaccaccuggagaagcgcaucgagaaccugaacaagaagguggacgacggcuuccucgacaucuggacguacaacgccgagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuaccccaaguacucggaggaggccaagcugaaccgggaggagaucgacggcgugaagcucgaguccacccgcaucuaccagauccuggcgaucuacagcaccguggccucgucccugguccucguggugagccugggggccaucuccuucuggaugugcagcaacggcucccugcagugccggaucugcaucuga

SEQ ID NO: 5319 - RNA, 1701 nt, Artificial Sequence
  derived and/or modified CDS sequence (AUadapt) from InfluenzaA__ADI49029__HA
auggaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgucguccuggagcuacaucguggagaccuccaucucggacaacggcacgugcuaccccggcgacuucaucgacuacgaggagcuccgggagcagcuguccagcguguccucguucgagcgcuucgagaucuuccccaagaccuccagcuggcccaaccacgacuccaacaagggggucaccgccgccugcccgcacgccggcgccaagucguucuacaagaaccugaucuggcucgugaagaaggggaacuccuaccccaagcugagcaaguccuacaucaacgacaagggcaaggaggugcugguccucugggggauccaccaccccucgaccagcgccgaccagcagucccuguaccagaacgccgacgccuacguguucgugggcucgucccgguacagcaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccggguccggcaucaucaucucggacacccccgugcacgacugcaacacgaccugccagaccccgaagggcgccaucaacaccucccugcccuuccacaacauccaccccaucacgaucgggaagugccccaaguacgucaagagcaccaagcugcggcucgcgaccggccugaagaacgugccguccauccagucgcgcgggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacucgaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagucgacccggaucuaccagauccuggcgaucuacuccaccgucgccagcucgcuggugcucguggucucccugggggccaucagcuucuggaugugcuccaacggcagccugcagugccgcaucugcaucuga

SEQ ID NO: 5320 - RNA, 1701 nt, Artificial Sequence; identical to SEQ ID NO: 3156
  derived and/or modified CDS sequence (AUadapt) from InfluenzaA__ADI49240__HA

SEQ ID NO: 5321 - RNA, 1701 nt, Artificial Sequence; identical to SEQ ID NO: 3156
  derived and/or modified CDS sequence (AUadapt) from InfluenzaA__ADI49260__HA

SEQ ID NO: 5322 - RNA, 1701 nt, Artificial Sequence
  derived and/or modified CDS sequence (AUadapt) from InfluenzaA__ADI49270__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgcccgggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggcgaucuacuccaccgucgccucgagccuggugcucguggucucccugggggccaucucguucuggaugugcuccaacggcagccugcagugccgcaucugcaucuga

SEQ ID NO: 5323 - RNA, 1701 nt, Artificial Sequence; identical to SEQ ID NO: 3156
  derived and/or modified CDS sequence (AUadapt) from InfluenzaA__ADI49280__HA

SEQ ID NO: 5324 - RNA, 1701 nt, Artificial Sequence; identical to SEQ ID NO: 3156
  derived and/or modified CDS sequence (AUadapt) from InfluenzaA__ADI49312__HA

SEQ ID NO: 5325 - RNA, 1701 nt, Artificial Sequence; identical to SEQ ID NO: 3156
  derived and/or modified CDS sequence (AUadapt) from InfluenzaA__ADI49322__HA

SEQ ID NO: 5326 - RNA, 1701 nt, Artificial Sequence; identical to SEQ ID NO: 3156
  derived and/or modified CDS sequence (AUadapt) from InfluenzaA__ADI49332__HA

SEQ ID NO: 5327 - RNA, 1701 nt, Artificial Sequence; identical to SEQ ID NO: 3483
  derived and/or modified CDS sequence (AUadapt) from InfluenzaA__ADI49342__HA

SEQ ID NO: 5328 - RNA, 1701 nt, Artificial Sequence; identical to SEQ ID NO: 3156
  derived and/or modified CDS sequence (AUadapt) from InfluenzaA__ADI49352__HA

SEQ ID NO: 5329 - RNA, 1701 nt, Artificial Sequence; identical to SEQ ID NO: 116
  derived and/or modified CDS sequence (AUadapt) from InfluenzaA__ADI49362__HA

SEQ ID NO: 5330 - RNA, 1701 nt, Artificial Sequence; identical to SEQ ID NO: 4466
  derived and/or modified CDS sequence (AUadapt) from InfluenzaA__ADI49382__HA

SEQ ID NO: 5331 - RNA, 1701 nt, Artificial Sequence; identical to SEQ ID NO: 3267
  derived and/or modified CDS sequence (AUadapt) from InfluenzaA__ADI49392__HA

SEQ ID NO: 5332 - RNA, 1701 nt, Artificial Sequence; identical to SEQ ID NO: 62
  derived and/or modified CDS sequence (AUadapt) from InfluenzaA__ADI49717__HA

SEQ ID NO: 5333 - RNA, 1701 nt, Artificial Sequence
  derived and/or modified CDS sequence (AUadapt) from InfluenzaA__ADI49727__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucgaucaucgagaagaugaacacccaguucaccgccgucggcaaggaguucaaccaccuggagaagcgcaucgagaaccugaacaagaagguggacgacggcuuccucgacaucuggacguacaacgccgagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuaccccaaguacucggaggaggccaagcugaaccgggaggagaucgacggcgugaagcucgaguccacccgcaucuaccagauccuggcgaucuacagcaccguggccucgucccugguccucguggugagccugggggccaucuccuucuggaugugcagcaacggcucccugcagugccggaucugcaucuga

SEQ ID NO: 5334 - RNA, 1701 nt, Artificial Sequence; identical to SEQ ID NO: 62
  derived and/or modified CDS sequence (AUadapt) from InfluenzaA__ADI49737__HA

SEQ ID NO: 5335 - RNA, 1701 nt, Artificial Sequence; identical to SEQ ID NO: 62
  derived and/or modified CDS sequence (AUadapt) from InfluenzaA__ADI49747__HA

SEQ ID NO: 5336 - RNA, 1701 nt, Artificial Sequence; identical to SEQ ID NO: 62
  derived and/or modified CDS sequence (AUadapt) from InfluenzaA__ADI49757__HA

SEQ ID NO: 5337 - RNA, 1701 nt, Artificial Sequence; identical to SEQ ID NO: 62
  derived and/or modified CDS sequence (AUadapt) from InfluenzaA__ADI49767__HA

SEQ ID NO: 5338 - RNA, 1701 nt, Artificial Sequence
  derived and/or modified CDS sequence (AUadapt) from InfluenzaA__ADI49777__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccucguccuggagcuacaucguggagaccuccucguccgacaacggcacgugcuaccccggcgacuucaucgacuacgaggagcugcgggagcagcucagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcuggugaagaaggggaacagcuaccccaagcucuccaagucguacaucaacgacaagggcaaggaggugcugguccugugggggauccaccaccccagcaccuccacggaccagcagucgcucuaccagaacgccgacgccuacguguucgugggcuccagccgguacuccaagaaguucaagcccgagaucgccauccgcccgaagguccgggaccaggagggccgcaugaacuacuacuggacccugguggagcccggggacaagaucaccuucgaggccaccggcaaccugguggucccccgguacgcguucgccauggagcgcaacgccgggucgggcaucaucaucuccgacacgcccgugcacgacugcaacacgaccugccagaccccgaagggcgccaucaacaccagccuccccuuccagaacauccaccccaucaccaucgggaagugccccaaguacgugaaguccaccaagcugcggcuggccaccggccuccgcaacgucccgucgauccagucccgggggcuguucggcgcgaucgccggguucaucgagggcggcuggacggggaugguggacggcugguacggguaccaccaccagaacgagcagggcagcggguacgccgccgaccugaaguccacccagaacgccaucgacgagaucaccaacaaggugaacucggucaucgagaagaugaacacccaguucacggcggugggcaaggaguucaaccaccucgagaagcgcaucgagaaccugaacaagaaggucgacgacggcuuccuggacaucuggaccuacaacgccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcuggaguccacccgcaucuaccagauccucgccaucuacagcaccgucgcgucgucccuggugcugguggucagccucggggccaucuccuucuggaugugcagcaacggcucccugcagugccggaucugcaucuga

SEQ ID NO: 5339 - RNA, 1701 nt, Artificial Sequence
  derived and/or modified CDS sequence (AUadapt) from InfluenzaA__ADI49787__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagcaucuccaccgccucguccuggagcuacaucguggagaccuccucguccgacaacggcacgugcuaccccggcgacuucaucgacuacgaggagcugcgggagcagcucagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcuggugaagaaggggaacagcuaccccaagcucuccaagucguacaucaacgacaagggcaaggaggugcugguccugugggggauccaccaccccagcaccuccgccgaccagcagucgcucuaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggucgggcaucaucaucuccgacacccccgugcacgacugcaacacgaccugccagaccccgaagggcgccaucaacaccagccuccccuuccagaacauccaccccaucacgaucgggaagugccccaaguacgugaaguccaccaagcugcggcuggcgaccggccuccgcaacgucccgucgauccagucccgggggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacucggucaucgagaagaugaacacccaguucaccgccgugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcuggaguccacccgcaucuaccagauccucgcgaucuacagcaccgucgccucgucccuggugcugguggucagccucggggccaucuccuucuggaugugcagcaacggcucccugcagugccggaucugcaucuga

SEQ ID NO: 5340 - RNA, 1701 nt, Artificial Sequence; identical to SEQ ID NO: 4249
  derived and/or modified CDS sequence (AUadapt) from InfluenzaA__ADI49822__HA

SEQ ID NO: 5341 - RNA, 1701 nt, Artificial Sequence
  derived and/or modified CDS sequence (AUadapt) from InfluenzaA__ADI50027__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcuccucgcgguacuccaagaaguucaagcccgagaucgccauccgcccgaagguccgggaccaggagggccgcaugaaguacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccucgcugcccuuccagaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacgggcaccaccaccagaacgagcagggcucgggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcaucaagcucgaguccacccgcaucuaccagauccuggcgaucuacucgaccguggccagcucccugguccucguggugucgcugggggccaucuccuucuggaugugcagcaacggcucccugcagugccggaucugcaucuga

SEQ ID NO: 5342 - RNA, 1701 nt, Artificial Sequence
  derived and/or modified CDS sequence (AUadapt) from InfluenzaA__ADI52834__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccagcuccgacaacggcacgugcuaccccggcgacuucaucgacuacgaggagcugcgggagcagcucucguccgugagcuccuucgagcgcuucgagaucuuccccaagaccucguccuggcccaaccacgacucgaacaagggggucaccgccgccugcccgcacgccggcgcgaaguccuucuacaagaaccugaucuggcuggugaagaaggggaacagcuaccccaagcucuccaagucguacaucaacgacaagggcaaggaggugcugguccugugggggauccaccacccgcccaccagcgccgaccagcagucccucuaccagaacgccgacgccuacguguucgugggcucgucccgguacagcaagaaguucaagcccgagaucgccauccgccccaagguccgggaccaggagggccgcaugaacuacuacuggacgcugguggagcccggggacaagaucaccuucgaggcgaccggcaaccugguggucccccgguacgccuucgccauggagcgcaacgccggguccggcaucaucaucucggacaccccggugcacgacugcaacacgaccugccagacccccaagggcgccaucaacaccucccuccccuuccagaacauccaccccaucacgaucgggaagugcccgaaguacgucaagagcaccaagcugcggcuggcgaccggccuccgcaacgugcccuccauccagucgcgggggcuguucggcgccaucgccggguucaucgagggcggcuggaccgggaugguggacggcugguacggguaccaccaccagaacgagcagggcuccggguacgccgccgaccucaagucgacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccuggacaucuggacguacaacgccgagcuccuggugcugcucgagaacgagcggacccuggacuaccacgacagcaacgugaagaaccuguacgagaagguccgcucccagcucaagaacaacgccaaggagguggggaacggcugcuucgaguucuaccacaagugcgacaacacgugcauggagucggugaagaacgggaccuacgacuaccccaaguacuccgaggaggccaagcugaaccgggaggagaucgacggcgucaagcuggagagcacccgcaucuaccagauccucgcgaucuacuccaccgccgccucgagccuggugcugguggucucccucggggccaucucguucuggaugugcuccaacggcagccugcagugccggaucugcaucuga

SEQ ID NO: 5343 - RNA, 1701 nt, Artificial Sequence
  derived and/or modified CDS sequence (AUadapt) from InfluenzaA__ADI52835__HA
auggaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccacccgcccaccucggccgaccagcagucccuguaccagaacgccgacgccuacguguucgugggcagcuccaaguacucgaagaaguucaagcccgagaucgccauccggcccaagguccgcgaccaggagggccggaugaacuacuacuggacgcugguggagcccggggacaagaucaccuucgaggcgaccggcaaccucguggucccccgcuacgccuucgccauggagcggaacgccggguccggcaucaucaucagcgacaccccggugcacgacugcaacacgaccugccagacccccaagggcgccaucaacaccucccugcccuuccacaacauccaccccaucacgaucgggaagugcccgaaguacgucaagucgaccaagcugcgccucgcgaccggccugcggaacgugcccuccauccagagccgcgggcuguucggcgccaucgccggguucaucgagggcggcuggaccgggaugguggacggcugguacggguaccaccaccagaacgagcagggcuccggguacgccgccgaccucaagucgacgcagaacgcgaucgacgagaucaccaacaaggugaacuccgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcaccaagaucuaccagauccuggcgaucuacuccaccgucgccucgagccuggugcucguggucucccugggggccaucucguucuggaugugcuccaacggcagccugcagugccggaucugcaucuga

SEQ ID NO: 5344 - RNA, 1701 nt, Artificial Sequence
  derived and/or modified CDS sequence (AUadapt) from InfluenzaA__ADI52836__HA
auggaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggagaacucguaccccaagcuguccaagagcuacaucaacgacaaggggaaggaggugcugguccucuggggcauccaccaccccucgaccuccgccgaccagcagcggcuguaccagaacgccgacgccuacguguucguggggagcuccaaguacucgaagaaguucaagcccgagaucgccauccgcccgaagguccgggaccaggagggccgcaugaacuacuacuggacgcugguggagcccggcgacaagaucaccuucgaggcgaccgggaaccucguggucccccgguacgccuucgccauggagcgcaacgccggcuccgggaucaucaucagcgacacccccgugcacgacugcaacacgaccugccagaccccgaagggcgccaucaacaccucccugcccuuccacaacauccaccccaucacgaucggcaagugccccaaguacgucaagucgaccaagcugcggcucgcgaccgggcugcgcaacgugccguccauccagagccggggccuguucggggccaucgccggcuucaucgagggcggguggaccggcaugguggacgggugguacggcuaccaccaccagaacgagcagggguccggcuacgccgccgaccucaagucgacgcagaacgcgaucgacgagaucaccaacaaggugaacuccgucaucgagaagaugaacacccaguucaccgccguggggaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcucgagagcaccaagaucuaccagauccuggcgaucuacuccaccgucgccucgagccuggugcucguggucucccugggcgccaucucguucuggaugugcuccaacgggagccugcagugccgcaucugcaucuga

SEQ ID NO: 5345 - RNA, 1701 nt, Artificial Sequence
  derived and/or modified CDS sequence (AUadapt) from InfluenzaA__ADI52837__HA
auggaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggucaagcacaacgggaagcucugcaagcugcgcggcguggcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgucucguccuucgagcgcuucgagaucuuccccaagaccagcuccuggcccaaccacgacagcaacaagggggugaccgccgccugcccgcacgccggcgcgaaguccuucuacaagaaccugaucuggcucgugaagaaggggaacucguaccccaagcuguccaagagcuacaucaacgacaagggcaaggagguccuggugcucugggggauccaccaccccucgaccuccgccgaccagcagagccuguaccagaacgccgacgccuacguguucgucggcuccucgaaguacuccaagaaguucaagcccgagaucgccauccggccgaaggugcgcgaccaggagggccggaugaacuacuacuggacgcugguggagcccggggacaagaucaccuucgaggcgaacggcaaccucgucgugccccgcuacgccuucgccauggagcggaacgccgggagcggcaucaucaucuccgacacccccgugcacgacugcaacaccacgugccagaccccgaagggcgccaucaacaccucgcugcccuuccacaacauccaccccaucaccaucgggaagugccccaaguacgucaaguccacgaagcugcgccucgcgaccggccugcggaacgugccgagcauccagucccgcgggcuguucggcgccaucgccggguucaucgagggcggcuggaccgggaugguggacggcugguacggguaccaccaccagaacgagcagggcagcggguacgccgccgaccucaaguccacccagaacgcgaucgacgagaucacgaacaaggucaacucggugaucgagaagaugaacacccaguucaccgccgucggcaaggaguucaaccaccuggagaagcggaucgagaaccugaacaagaagguggacgacggcuuccucgacaucuggaccuacaacgccgagcugcuggugcuccuggagaacgagcgcacgcuggacuaccacgacuccaacgucaagaaccucuacgagaaggugcggagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgcgaggagaucgacggcgucaagcucgaguccaccaagaucuaccagauccuggcgaucuacagcaccguggccucgucccuggugcucgucgugagccugggggccaucuccuucuggaugugcagcaacggcucccugcagugccggaucugcaucuga

SEQ ID NO: 5346 - RNA, 1701 nt, Artificial Sequence; identical to SEQ ID NO: 3712
  derived and/or modified CDS sequence (AUadapt) from InfluenzaA__ADI72915__HA

SEQ ID NO: 5347 - RNA, 1701 nt, Artificial Sequence; identical to SEQ ID NO: 3712
  derived and/or modified CDS sequence (AUadapt) from InfluenzaA__ADI72916__HA

SEQ ID NO: 5348 - RNA, 1701 nt, Artificial Sequence; identical to SEQ ID NO: 3712
  derived and/or modified CDS sequence (AUadapt) from InfluenzaA__ADI72917__HA

SEQ ID NO: 5349 - RNA, 1701 nt, Artificial Sequence
  derived and/or modified CDS sequence (AUadapt) from InfluenzaA__ADI72918__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacccgaacaagggggucaccgccgccugcccccacgccggcgccaagagcuucuacaagaaccugaucuggcucgugaagaaggggaacuccuaccccaagcugucgaaguccuacaucaacgaccggggcaaggaggugcugguccucugggggauccaccaccccagcaccucggccgaccagcagucccuguaccagaacgccgacgccuacguguucgugggcacgucgcgcuacuccaagaaguucaagccggagaucgccauccggcccaagguccgcgaccaggagggccggaugaacuacuacuggacccugguggagcccggggacaagaucaccuucgaggcgaccggcaaccucguggucccccgcuacgccuucgccauggagcggaacgccgggagcggcaucaucaucuccgacacgccggugcacgacugcaacacgaccugccagacccccaagggcgccaucaacaccucgcugcccuuccagaacauccaccccaucaccaucgggaagugcccgaaguacgugaaguccaccaagcugcgccucgcgaccggccugcggaacguccccagcauccagucccgcgggcuguucggcgccaucgccggguucaucgagggcggcuggacggggaugguggacggcugguacggguaccaccaccagaacgagcagggcucgggguacgccgccgaccucaaguccacccagaacgcgaucgacgagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaacgugaagaagcucuacgagaagguccggucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgugaagcucgaguccacccggaucuaccagauccuggcgaucuacucgaccgucgccuccagccuggugcucguggucucgcugggggccaucuccuucuggaugugcagcaacggcucccugcagugccgcaucugcaucuga

SEQ ID NO: 5350 - RNA, 1701 nt, Artificial Sequence; identical to SEQ ID NO: 3712
  derived and/or modified CDS sequence (AUadapt) from InfluenzaA__ADI72919__HA

SEQ ID NO: 5351 - RNA, 1701 nt, Artificial Sequence; identical to SEQ ID NO: 3712
  derived and/or modified CDS sequence (AUadapt) from InfluenzaA__ADI72920__HA

SEQ ID NO: 5352 - RNA, 1701 nt, Artificial Sequence
  derived and/or modified CDS sequence (AUadapt) from InfluenzaA__ADI72921__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacccgaacaagggggucaccgccgccugcccccacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacguguucgugggcacgucgcgguacuccaagaaguucaagccggagaucgccauccgccccaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgccggugcacgacugcaacacgaccugccagacccccaagggcgccaucaacaccucgcugcccuuccagaacauccaccccaucaccaucgggaagugcccgaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcucgggguacgccgccgaccucaaguccacccagaacgcgcuggacgagaucaccaacaaggugaacagcgucaucgagaagaugaacacccaguucacggccgugggcaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacuccaacgugaagaaccuguacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcucaaccgggaggagaucgacggcgugaagcuggaguccacccgcaucuaccagauccuggcgaucuacucgaccgucgccuccagccucgugcugguggucucgcugggggccaucuccuucuggaugugcagcaacggcucccuccagugccggaucugcaucuga

SEQ ID NO: 5353 - RNA, 1701 nt, Artificial Sequence; identical to SEQ ID NO: 116
  derived and/or modified CDS sequence (AUadapt) from InfluenzaA__ADI72922__HA

SEQ ID NO: 5354 - RNA, 1701 nt, Artificial Sequence
  derived and/or modified CDS sequence (AUadapt) from InfluenzaA__ADI72923__HA
augaaggccauccuggugguccuccuguacaccuucgccaccucgaacgcggacacgcugugcaucggcuaccacgccaacaacuccaccgacaccguggacaccgugcucgagaagaacgucacggugacccacucggugaaccugcuggaggacaagcacaacgggaagcucugcaagcugcgcggcgucgcgccccugcaccucgggaagugcaacaucgccggcuggauccuggggaacccggagugcgagucccugagcaccgccuccucgugguccuacaucguggagaccagcuccucggacaacggcacgugcuaccccggcgacuucaucgacuacgaggagcuccgggagcagcuguccagcguguccucguucgagcgcuucgagaucuuccccaagaccuccagcuggcccaaccacgacccgaacaagggggucaccgccgccugcccccacgccggcgccaaguccuucuacaagaaccugaucuggcucgugaagaaggggaacucguaccccaagcuguccaagagcuacaucaacgacaagggcaaggaggugcugguccucugggggauccaccaccccucgaccuccgcggaccagcagucgcuguaccagaacgccgacgccuacguguucgugggcacgucccgguacagcaagaaguucaagccggagaucgccauccgccccaagguccgggaccaggagggccgcaugaacuacuacuggacccugguggagcccggggacaagaucaccuucgaggccaccggcaaccucguggucccccgguacgcguucgccauggagcgcaacgccgggccgggcaucaucaucuccgacacgcccgugcacgacugcaacacgaccugccagacccccaagggcgccaucaacaccucgcugcccuuccagaacauccacccgaucaccaucgggaagugccccaaguacgugaaguccaccaagcugcggcucgccaccggccugcgcaacguccccagcauccagucccgggggcuguucggcgcgaucgccggguucaucgagggcggcuggacggggaugguggacggcugguacggguaccaccaccagaacgagcagggcucgggguacgccgccgaccucaaguccacccagaacgccaucgacgagaucaccaacaaggugaacagcgucaucgagaagaugaacacccaguucacggcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggccaucuacucgaccgucgcguccagccuggugcucguggucucgcugggggccaucuccuucuggaugugcagcaacggcucccugcagugccggaucugcaucuga

SEQ ID NO: 5355 - RNA, 1701 nt, Artificial Sequence; identical to SEQ ID NO: 3712
  derived and/or modified CDS sequence (AUadapt) from InfluenzaA__ADI72924__HA

SEQ ID NO: 5356 - RNA, 1701 nt, Artificial Sequence; identical to SEQ ID NO: 116
  derived and/or modified CDS sequence (AUadapt) from InfluenzaA__ADI72925__HA

SEQ ID NO: 5357 - RNA, 1701 nt, Artificial Sequence
  derived and/or modified CDS sequence (AUadapt) from InfluenzaA__ADI72926__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacccgaacaagggggucaccgccgccugcccccacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacguguucgugggcacgucgggcuacuccaagaaguucaagccggagaucgccauccggcccaagguccgcgaccaggaggggcggaugaacuacuacuggacccugguggagcccggcgacaagaucaccuucgaggcgaccgggaaccucguggucccccgcuacgccuucgccauggagcggaacgccggcagcggcaucaucaucuccgacacgccggugcacgacugcaacacgaccugccagacccccaagggggccaucaacaccucgcugcccuuccagaacauccaccccaucaccaucggcaagugcccgaaguacgugaaguccaccaagcugcgccucgcgaccgggcugcggaacguccccagcauccagucccgcggccuguucggggccaucgccggcuucaucgagggcggguggacgggcaugguggacgggugguacggcuaccaccaccagaacgagcaggggucgggcuacgccgccgaccucaaguccacccagaacgcgaucgacgagaucaccaacaaggugaacagcgucaucgagaagaugaacacccaguucacggccgugggcaaggaguucaaccaccuggagaagcggaucgagaaccugaacaagaaggucgacgacggguuccucgacaucuggaccuacaacgccgagcugcuggugcuccuggagaacgagcgcacccuggacuaccacgacuccaacgugaagaaccucuacgagaagguccggucgcagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgcgaggagaucgacggggugaagcucgaguccacccggaucuaccagauccuggcgaucuacucgaccgucgccuccagccuggugcucguggucucgcugggcgccaucuccuucuggaugugcagcaacggcucccugcagugccgcaucugcaucuga

SEQ ID NO: 5358 - RNA, 1701 nt, Artificial Sequence
  derived and/or modified CDS sequence (AUadapt) from InfluenzaA__ADI72927__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccagcuccgacaacggcacgugcuaccccggcgacuucaucgacuacgaggagcuccgggagcagcugucguccgugucguccuucgagcgcuucgagaucuuccccaagaccagcuccuggcccaaccacgacccgaacaagggggucaccgccgccugcccccacgccggcgccaagucguucuacaagaaccugaucuggcucgugaagaaggggaacuccuaccccaagcugagcaaguccuacaucaacgacaagggcaaggaggugcugguccucugggggauccaccaccccucgaccagcgccgaccagcagucccuguaccagaacgccgacgccuacguguucgugggcacgucgcgguacuccaagaaguucaagccggagaucgccauccgccccaagguccgggaccaggagggccgcaugaacuacuacuggacccugguggagcccggggacaagaucaccuucgaggcgaccggcaaccucguggucccccgguacgccuucgccauggagcgcaacgccgggucgggcaucaucacguccgacaccccggugcacgacugcaacacgaccugccagacccccaagggcgccaucaacaccagccugcccuuccagaacauccaccccaucaccaucgggaagugcccgaaguacgugaaguccaccaagcugcggcucgcgacgggccugcgcaacguccccucgauccagucccgggggcuguucggcgccaucgccggguucaucgagggcggcuggaccgggaugguggacggcugguacggguaccaccaccagaacgagcagggcagcggguacgccgccgaccucaaguccacccagaacgcgaucgacgagaucaccaacaaggugaacucggucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 5359 - RNA, 1701 nt, Artificial Sequence
  derived and/or modified CDS sequence (AUadapt) from InfluenzaA__ADI72928__HA
augaaggccauccuggugguccuccuguacaccuucgccaccgcgaacgccgacacgcugugcaucggcuaccacgccaacaacucgaccgacaccguggacaccauccucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagucgcuguccaccgcgagcuccuggucguacaucgucgagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacccgaacaagggggugaccgccgccugcccccacgccggcgccaagagcuucuacaagaaccugaucuggcucgucaagaaggggaacuccuaccccaagcugucgaaguccuacaucaacgacaagggcaaggaggugcuggugcucugggggauccaccaccccagcaccucggccgaccagcagucccuguaccagaacgccgacgccuacgucuucgugggcacgucgcgguacuccaagaaguucaagccggagaucgccauccgccccaaggugcgggaccaggagggccgcaugaacuacuacuggacccuggucgagcccggggacaagaucaccuucgaggcgaccggcaaccucguggugccccgguacgccuucgccauggagcgcaacgccgggagcggcaucaucaucuccgacacgccgguccacgacugcaacacgaccugccagacccccaagggcgccaucaacaccucgcugcccuuccagaacauccaccccaucaccaucgggaagugcccgaaguacgugaaguccaccaagcugcggcucgcgaccggccugcgcaacgugcccagcauccagucccgggggcuguucggcgccaucgccggguucaucgagggcggcuggacggggauggucgacggcugguacggguaccaccaccagaacgagcagggcucgggguacgccgccgaccucaaguccacccagaacgcgaucgacgagaucaccaacaaggugaacagcgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcucgcagcugaagaacaacgccaaggagaucgggaacggcugcuucgaguucuaccacaagugcgacaacacgugcauggaguccgucaagaacgggaccuacgacuaccccaaguacagcgaggaggccaagcugaaccggaaggagaucgacggcgugaagcucgaguccacccgcaucuaccagauccuggcgaucuacucgaccguggccuccagccugguccucguggugucgcugggggccaucuccuucuggaugugcagcaacggcucccugcagugccggaucugcaucuga

SEQ ID NO: 5360 - RNA, 1701 nt, Artificial Sequence; identical to SEQ ID NO: 116
  derived and/or modified CDS sequence (AUadapt) from InfluenzaA__ADI72929__HA

SEQ ID NO: 5361 - RNA, 1701 nt, Artificial Sequence; identical to SEQ ID NO: 116
  derived and/or modified CDS sequence (AUadapt) from InfluenzaA__ADI72930__HA

SEQ ID NO: 5362 - RNA, 1701 nt, Artificial Sequence
  derived and/or modified CDS sequence (AUadapt) from InfluenzaA__ADI72931__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacccgaacaagggggucaccgccgccugcccccacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacguguucgugggcacgucgcgguacuccaagaaguucaagccggagaucgccauccgccccaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgccggugcacgacugcaacacgaccugccagacccccaagggcgccaucaacaccucgcugcccuuccagaacauccaccccaucaccaucgggaagugcccgaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcucgggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcaucaagcucgaguccacccgcaucuaccagauccuggcgaucuacucgaccguggccuccagccugguccucguggugucgcugggggccaucuccuucuggaugugcagcaacggcucccugcagugccggaucugcaucuga

SEQ ID NO: 5363 - RNA, 1701 nt, Artificial Sequence; identical to SEQ ID NO: 4570
  derived and/or modified CDS sequence (AUadapt) from InfluenzaA__ADI72932__HA

SEQ ID NO: 5364 - RNA, 1698 nt, Artificial Sequence
  derived and/or modified CDS sequence (AUadapt) from InfluenzaA__ADI75818__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccucgugcucccacaacggcgagagcuccuucuacaagaaccugcuguggcucaccgagaagaacgggcuguaccccaaccugagcaaguccuacgccaacaacaaggagaaggaggugcucguccuguggggcgugcaccacccgcccagcaucucggaccagaagacccuguaccacacggagaacgccuacguguccgucgugagcucccacuacagccgcaaguucacccccgagaucgccaagcggcccaaggugcgcgaccaggaggggcggaucaacuacuacuggacccuccuggagcccggcgacaccaucaucuucgaggccaacggcaaccugaucgcgccgcgcuacgccuucgcccucucccggggguucggcucggggaucaucaacuccaacgcccccauggacaagugcgacgccaagugccagacgccccagggcgcgaucaacagcucccugcccuuccagaacguccacccggugaccaucggcgagugccccaaguacgugcgcagcgccaagcugcggauggucaccgggcuccgcaacauccccuccauccagagccggggccuguucggggccaucgccggcuucaucgagggcggcuggaccggcaugguggacgggugguacggcuaccaccaccagaacgagcagggguccggcuacgccgcggaccagaaguccacgcagaacgccaucaacgggaucaccaacaaggugaacucggucaucgagaagaugaacacccaguucaccgccgugggcaaggaguucaacaagcuggagcgccggauggagaaccucaacaagaaggucgacgacggcuucaucgacaucuggacguacaacgccgagcugcuggugcuccuggagaacgagcgcacccuggacuuccacgacagcaacgugaagaaccucuacgagaaggucaagaaccagcugaagaacaacgccaaggagaucgggaacggcugcuucgaguucuaccacaagugcaacgacgagugcauggaguccgugaagaacgggaccuacgacuaccccaaguacagcgaggaguccaagcugaaccgggagaagaucgacggcgugaagcucgagagcaugggggucuaccagauccuggcgaucuacucgaccguggccuccagccuggugcuccuggucucccugggcgccaucagcuucuggaugugcuccaacggcagccuccagugccgcaucugcaucuga

SEQ ID NO: 5365 - RNA, 1698 nt, Artificial Sequence
  derived and/or modified CDS sequence (AUadapt) from InfluenzaA__ADI75851__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcggccuccugaucagcaaggaguccuggagcuacaucguggagaagcccaaccccgagaacgggaccugcuaccccgggcacuucgccgacuacgaggagcugcgcgagcagcucuccucgguguccagcuucgagcgguucgagaucuucccgaaggaguccagcuggcccaaccacacggucaccggcguguccgccagcugcucccacaacggggagucguccuucuaccgcaaccugcuguggcucaccggcaagaacgggcuguaccccaaccugagcaaguccuacgccaacaacaaggagaaggaggugcucguccuguggggcgugcaccacccgcccaacaucguggaccagaagacccuguaccggacggagaacgccuacgucagcguggugagcucccacuacucgcgcaaguucacccccgagaucgccaagcggcccaagguccgcgaccaggagggccggaucaacuacuacuggacccuccuggagcccggggacaccaucaucuucgaggccaacggcaaccugaucgcgccgcgcuacgccuucgcccucucccggggguucggcagcggcaucaucaacuccaacgcccccauggggaagugcgacgccaagugccagacgccccagggcgcgaucaacagcucccugcccuuccagaacgugcacccggugaccaucggggagugccccaaguacguccgcagcgccaagcugcggauggugaccggccuccgcaacauccccuccauccagucgcgggggcuguucggcgccaucgccggcuucaucgagggcggcuggaccgggaugguggacggcugguacggguaccaccaccagaacgagcagggcuccggcuacgccgcggaccagaaguccacgcagaacgccaucaacgggaucaccaacaaggucaacagcgugaucgagaagaugaacacccaguucaccgccgucggcaaggaguucaacaagcuggagcgccggauggagaaccucaacaagaagguggacgacggguucaucgacaucuggacguacaacgccgagcugcuggugcuccuggagaacgagcgcacccuggacuuccacgacagcaacgucaagaaccucuacgagaaggugaagucccagcugaagaacaacgccaaggagaucggcaacgggugcuucgaguucuaccacaagugcaacgacgagugcauggagagcgugaagaacggcaccuacgacuaccccaaguacuccgaggagucgaagcugaaccgggagaagaucgacggcgucaagcucgaguccauggggguguaccagauccuggcgaucuacagcaccguggccagcucccugguccuccuggugagccugggcgccaucuccuucuggaugugcagcaacgggucccuccagugccgcaucugcaucuga

SEQ ID NO: 5366 - RNA, 1701 nt, Artificial Sequence; identical to SEQ ID NO: 2679
  derived and/or modified CDS sequence (AUadapt) from InfluenzaA__ADI75884__HA

SEQ ID NO: 5367 - RNA, 1701 nt, Artificial Sequence; identical to SEQ ID NO: 2679
  derived and/or modified CDS sequence (AUadapt) from InfluenzaA__ADI75917__HA

SEQ ID NO: 5368 - RNA, 1698 nt, Artificial Sequence
  derived and/or modified CDS sequence (AUadapt) from InfluenzaA__ADI77349__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccucguggcccaaccacacggucaccgggguguccgccagcugcucccacaacggcgagaacagcuucuaccgcaaccugcuguggcucaccgggaagaacggccuguaccccaaccuguccaagucguacgccaacaacaaggagaaggaggugcucauccuguggggcguccaccacccgcccaacauggccgaccagaagacccuguaccacacggagaacgccuacguguccguggucagcagccacuacucccggaaguucacccccgagaucgccaagcgccccaaggugcgggaccaggagggccgcaucaacuacuacuggacccuccuggagcccggcgacaccaucaucuucgaggcgaacgggaaccugaucgccccgcgguacgccuucgcccucucgcgcggcuucggguccggcaucaucaacagcaacgcccccauggacaagugcgacacgaagugccagacgccccagggcgcgaucaacuccagccugcccuuccagaacgugcacccggucaccaucggggagugccccaaguacgugcgguccgccaagcugcgcauggugaccggccuccggaacauccccucgauccagucccgcgggcuguucggcgccaucgccggguucaucgagggcggcuggaccgggauggucgacggcugguacggguaccaccaccagaacgagcagggcagcggguacgccgcggaccagaaguccacccagaacgccaucaacggcaucaccaacaaggugaacagcgugaucgagaagaugaacacccaguucacggccgucggcaaggaguucaacaagcuggagcggcgcauggagaaccucaacaagaagguggacgacggguucaucgacaucuggaccuacaacgccgagcugcugguccuccuggagaacgagcggacccuggacuuccacgacuccaacgugaagaaccucuacgagaaggucaagucgcagcugaagaacaacgccaaggagaucggcaacgggugcuucgaguucuaccacaagugcaacgacgagugcauggaguccgugaagaacggcaccuacgacuaccccaaguacagcgaggaguccaagcugaaccgcgagaagaucgacggggugaagcucgagagcaugggcguguaccagauccuggcgaucuacuccacggucgccucgagccuggugcuccuggugucccugggcgccaucagcuucuggaugugcuccaacgggagccuccagugccggaucugcaucuga

SEQ ID NO: 5369 - RNA, 1701 nt, Artificial Sequence; identical to SEQ ID NO: 116
  derived and/or modified CDS sequence (AUadapt) from InfluenzaA__ADI77360__HA

SEQ ID NO: 5370 - RNA, 1701 nt, Artificial Sequence
  derived and/or modified CDS sequence (AUadapt) from InfluenzaA__ADI99498__HA
augaagaccauccuggugguccuccuguacaccuucgccacggccaacgcggacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagacguccagcuccgacaacgggaccugcuaccccggcgacuucaucgacuacgaggagcuccgggagcagcugucguccgugagcuccuucgagcgcuucgagaucuuccccaagaccucguccuggcccaaccacgacagcaacaagggcgucaccgccgccugcccgcacgccggcgccaaguccuucuacaagaaccugaucuggcucgugaagaaggggaacucguaccccaagcugaacaaguccuacaucaacgacaagggcaaggaggugcugguccucugggggauccaccaccccagcacgucggcggaccagcagucccuguaccagaacgccgacgccuacguguucgugggcaccucgcgguacuccaagaaguucaagcccgagaucgccauccgcccgaagguccggggccaggaggggcgcaugaacuacuacuggacccuggugaagcccggcgacaagaucaccuucgaggccacggggaaccucguggucccccgguacgcguucgccauggagcgcaacgccggcagcggcaucaucaucuccgacacccccgugcacgacugcaacacgaccugccagaccccgaagggggccaucaacaccucgcugcccuuccagaacauccaccccaucaccaucggcaagugccccaaguacgugaaguccaccaagcugcggcucgccacggggcugcgcaacgucccgagcauccagucccggggccuguucggggcgaucgccggcuucaucgagggcggguggaccggcaugguggacgggugguacggcuaccaccaccagaacgagcaggggucgggcuacgccgccgaccucaaguccacccagaacgccaucgacgagaucaccaacaaggugaacagcgucaucgagaagaugaacacgcaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcaucuaccagauccuggccaucuacucgaccgucgcguccagccuggugcucguggucucgcugggcgccaucuccuucuggaugugcagcaacggcucccugcagugccggaucugcaucuga

SEQ ID NO: 5371 - RNA, 1701 nt, Artificial Sequence
  derived and/or modified CDS sequence (AUadapt) from InfluenzaA__ADI99560__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcaacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 5372 - RNA, 1701 nt, Artificial Sequence; identical to SEQ ID NO: 5371
  derived and/or modified CDS sequence (AUadapt) from InfluenzaA__ADI99570__HA

SEQ ID NO: 5373 - RNA, 1701 nt, Artificial Sequence; identical to SEQ ID NO: 5371
  derived and/or modified CDS sequence (AUadapt) from InfluenzaA__ADI99580__HA

SEQ ID NO: 5374 - RNA, 1701 nt, Artificial Sequence; identical to SEQ ID NO: 4527
  derived and/or modified CDS sequence (AUadapt) from InfluenzaA__ADI99590__HA

SEQ ID NO: 5375 - RNA, 1701 nt, Artificial Sequence
  derived and/or modified CDS sequence (AUadapt) from InfluenzaA__ADI99610__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggagauccuggugcucugggggauccaccaccccucgaccuccgccgaccagcagagccuguaccagaacgccgacgccuacgucuucgugggcacgucccgguacucgaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgagccugguccucguggugucccugggggccaucucguucuggaugugcuccaacggcagccugcagugccggaucugcaucuga

SEQ ID NO: 5376 - RNA, 1701 nt, Artificial Sequence
  derived and/or modified CDS sequence (AUadapt) from InfluenzaA__ADI99620__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucacggacacccccgugcacgacugcaacacgaccugccagaccccgaagggcgccaucaacaccucgcugcccuuccagaacauccaccccaucaccaucgggaagugccccaaguacgugaaguccaccaagcugcggcucgcgacgggccugcgcaacgucccgagcauccagucccgggggcuguucggcgccaucgccggguucaucgagggcggcuggaccgggaugguggacggcugguacggguaccaccaccagaacgagcagggcucgggguacgccgccgaccucaaguccacccagaacgcgaucgacaagaucaccaacaaggugaacagcgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 5377 - RNA, 1701 nt, Artificial Sequence
  derived and/or modified CDS sequence (AUadapt) from InfluenzaA__ADI99630__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagaacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcaacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 5378 - RNA, 1701 nt, Artificial Sequence
  derived and/or modified CDS sequence (AUadapt) from InfluenzaA__ADI99640__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccacggaccagcagucgcuguaccagaacgccgacuccuacguguucgugggcaccagccgguacuccaagaaguucaagcccgagaucgccauccgcccgaagguccgggaccaggagggccgcaugaacuacuacuggacccugguggagcccggggacaagaucaccuucgaggccacgggcaaccucguggucccccgguacgccuucgcgauggagcgcaacgccgggucgggcaucaucaucuccgacacccccauccacgacugcaacacgaccugccagaccccggagggcgccaucaacaccagccugcccuuccagaacauccaccccaucaccaucgggaagugccccaaguacgugaaguccaccaagcugcggcucgccacgggccugcgcaacgugccgucgauccagucccgggggcuguucggcgccaucgcgggguucaucgagggcggcuggaccgggauggucgacggcugguacggguaccaccaccagaacgagcagggcagcggguacgccgccgaccucaaguccacccagaacgccaucgacgagaucaccaacaaggugaacucggugaucgagaagaugaacacgcaguucaccgccgucggcaaggaguucaaccaccuggagaagcgcaucgagaaccugaacaagaagguggacgacggcuuccucgacaucuggaccuacaacgcggagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuaccccaaguacucggaggaggccaagcugaaccgggaggagaucgacggcgugaagcucgaguccacccgcaucuaccagauccuggccaucuacagcaccguggccucgucccugguccucguggugagccugggggcgaucuccuucuggaugugcagcaacggcucccugcagugccggaucugcaucuga

SEQ ID NO: 5379 - RNA, 1701 nt, Artificial Sequence; identical to SEQ ID NO: 4466
  derived and/or modified CDS sequence (AUadapt) from InfluenzaA__ADI99660__HA

SEQ ID NO: 5380 - RNA, 1701 nt, Artificial Sequence
  derived and/or modified CDS sequence (AUadapt) from InfluenzaA__ADI99670__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccagcuccgacaacggcacgugcuaccccggcgacuucaucgacuacgaggagcugcgggagcagcucucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcuggugaagaaggggaacucguaccccaagcucuccaagagcuacaucaacgacaagggcaaggaggugcugguccugugggggauccaccaccccucgaccuccgccgaccagcagagccucuaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucgccauggagcgcaacgccggguccggcaucaucaucagcgacacgcccgugcacgacugcaacacgaccugccagaccccgaagggcgccaucaacaccucccuccccuuccagaacauccaccccaucaccaucgggaagugccccaaguacgucaagucgaccaagcugcggcuggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagucggugaagaacgggaccuacggcuaccccaaguacuccgaggaggccaagcugaaccgggaggagaucgacggggugaagcuggagagcacccgcaucuaccagauccucgcgaucuacuccaccgucgccucgagccuggugcugguggucucccucggcgccaucucguucuggaugugcuccaacggcagccugcagugccggaucugcaucuga

SEQ ID NO: 5381 - RNA, 1701 nt, Artificial Sequence
  derived and/or modified CDS sequence (AUadapt) from InfluenzaA__ADI99680__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccagcuccgacaacggcacgugcuaccccggcgacuucaucgacuacgaggagcugcgggagcagcucucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcuggugaagaaggggaacucguaccccaagcucuccaagagcuacaucaacgacaagggcaaggaggugcugguccugugggggauccaccaccccucgaccuccgccgaccagcagagccucuaccagaacgccgacgccuacguguucgugggcacgucccgguacucgaagaaguucaagcccgagaucgccauccgcccgaagguccgggaccaggagggccgcaugaacuacuacuggaccaucguggagcccggggacaagaucaccuucgaggcgaccggcaaccugguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcuccggcuggcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacagcaacgugaagaaccuguacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcucaaccgggaggagaucgacggcgugaagcuggagagcacccgcaucuaccagauccuggcgaucuacuccaccgucgccucgagccucgugcugguggucucccugggggccaucucguucuggaugugcuccaacggcagccuccagugccggaucugcaucuga

SEQ ID NO: 5382 - RNA, 1701 nt, Artificial Sequence
  derived and/or modified CDS sequence (AUadapt) from InfluenzaA__ADI99690__HA
augaaggccauccuggccgugcuccuguacaccuucgcgaucgccaacgccgacacccugugcaucggcuaccacgccaacaacucgacggacaccgucgacaccgugcucgagaagaacgugaccgucacgcacuccgugaacauccuggaggacaagcacaacgggaagcugugcaagcuccgcggcguggcgccccugcaccuggggaagugcaacaucgccggcuggauccucgggaacccggagugcgagucgcuguccaccgccagcuccuggucguacaucgucgagaccuccagcuccgacaacgggaccugcuaccccggcgacuucaucgacuacgaggagcugcgggagcagcucucguccgugagcuccuucgagcgcuucgagaucuuccccaagacgucguccuggcccaaccacgacagcaacaagggcgugaccgccgccugcccgcacgcgggcgccaaguccuucuacaagaaccugaucuggcuggucaagaaggggaacucguaccccaagcucuccaagagcuacaucaacgacaagggcaagaaggugcuggugcugugggggauccaccaccccucgaccuccgccgaccagcagagccucuaccagaacgccgacgccuacgucuucgugggcaccucccgguacucgaagaaguucaagcccgagaucgcgauccgcccgaaggugcgggaccaggagggccgcaugaacuacuacuggacgcuggucgagcccggggacaagaucaccuucgaggccaccggcaaccugguggugccccgguacgccuucgccauggagcgcaacgccggguccggcaucaucaucagcgacacccccguccacgacugcaacacgaccugccagaccccgaagggcgcgaucaacaccucccuccccuuccagaacauccaccccaucacgaucgggaagugccccaaguacgucaagucgaccaagcugcggcuggccaccggccuccgcaacgugccguccauccagagccgggggcuguucggcgccaucgccggguucaucgagggcggcuggaccgggaugguggacggcugguacggguaccaccaccagaacgagcagggcuccggguacgccgcggaccucaagucgacgcagaacgccaucgacgagaucaccaacaaggugaacuccgugaucgagaagaugaacacccaguucaccgccgucggcaaggaguucaaccaccuggagaagcgcaucgagaaccugaacaagaagguggacgacggcuuccuggacaucuggacguacaacgccgagcuccugguccugcucgagaacgagcggacccuggacuaccacgacagcaacgugaagaaccuguacgagaaggugcgcucccagcucaagaacaacgccaaggagaucgggaacggcugcuucgaguucuaccacaagugcgacaacacgugcauggagucggucaagaacgggaccuacgacuaccccaaguacuccgaggaggcgaagcugaaccgggaggagaucgacggcgugaagcuggagagcacccgcaucuaccagauccucgccaucuacuccaccguggccucgagccugguccugguggugucccucggggccaucucguucuggaugugcuccaacggcagccugcagugccggaucugcaucuga

SEQ ID NO: 5383 - RNA, 1701 nt, Artificial Sequence
  derived and/or modified CDS sequence (AUadapt) from InfluenzaA__ADI99700__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucucgccccugcaccucgggaagugcaacaucgccggcuggauccuggggaacccggagugcgagucccugagcaccgccuccucgugguccuacaucguggagaccagcuccucggacaacggcacgugcuaccccggcgacuucaucgacuacgaggagcuccgggagcagcuguccagcguguccucguucgagcgcuucgagaucuuccccaagaccuccagcuggcccaaccacgacuccaacaagggggucaccgcggccugcccgcacgccggcgccaagucguucuacaagaaccugaucuggcucgugaagaaggggaacuccuaccccaagcugagcaagucguacaucaacgacaagggcaaggaggugcugguccucuggggcgugcaccaccccuccaccagcgcggaccagcagucccuguaccagaacgccgacgccuacguguucgucgggacgucgcgguacuccaagaaguucaagcccgagaucgccauccgcccgaaggugcgggaccaggagggccgcaugaacuacuacuggacccugguggagcccggggacaagaucaccuucgaggccaccggcaaccucgucgcgccccgguacgccuucgccauggagcgcaacgccgggagcggcaucaucaucuccgacacgcccgugcacgacugcaacacgaccugccagaccccgaagggcgccaucaacaccucgcugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcucgggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccagcucccuggugcucguggucucgcugggggccaucuccuucuggaugugcagcaacggcucccugcagugccggaucugcaucuga

SEQ ID NO: 5384 - RNA, 1701 nt, Artificial Sequence; identical to SEQ ID NO: 4563
  derived and/or modified CDS sequence (AUadapt) from InfluenzaA__ADI99710__HA

SEQ ID NO: 5385 - RNA, 1701 nt, Artificial Sequence
  derived and/or modified CDS sequence (AUadapt) from InfluenzaA__ADI99720__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccgaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccggggccaggaggggcgcaugaacuacuacuggacccugguggagcccggcgacaagaucaccuucgaggcgaccgggaaccucguggucucccgguacgccuucgccauggagcgcaacgccggcucgggcaucaucaucuccgacacgcccgugcacgacugcaacacgaccugccagacccccaagggggccaucaacaccagccugccguuccagaacauccaccccaucaccaucggcaagugccccaaguacgugaaguccaccaagcugcggcucgcgaccgggcugcgcaacguccccucgauccagucccggggccuguucggggccaucgccggcuucaucgagggcggguggacgggcaugguggacgggugguacggcuaccaccaccagaacgagcaggggagcggcuacgccgccgaccucaaguccacccagaacgcgaucgacgagaucaccaacaaggugaacucggucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacuccaacgugaagaaccucuacgagaagguccgcagccagcugaagaacaacgccaaggagaucggcaacgggugcuucgaguucuaccacaagugcgacaacacgugcauggaguccgugaagaacggcaccuacgacuacccgaaguacucggaggaggccaagcugaaccgggaggagaucgacggggugaagcucgaguccacccgcaucuaccagauccuggcgaucuacagcaccgucgccucgucccuggugcucguggucagccugggcgccaucuccuucuggaugugcagcaacggcucccugcagugccggaucugcaucuga

SEQ ID NO: 5386 - RNA, 1701 nt, Artificial Sequence; identical to SEQ ID NO: 116
  derived and/or modified CDS sequence (AUadapt) from InfluenzaA__ADI99730__HA

SEQ ID NO: 5387 - RNA, 1701 nt, Artificial Sequence; identical to SEQ ID NO: 116
  derived and/or modified CDS sequence (AUadapt) from InfluenzaA__ADJ00497__HA

SEQ ID NO: 5388 - RNA, 1701 nt, Artificial Sequence; identical to SEQ ID NO: 116
  derived and/or modified CDS sequence (AUadapt) from InfluenzaA__ADJ00498__HA

SEQ ID NO: 5389 - RNA, 1701 nt, Artificial Sequence; identical to SEQ ID NO: 4108
  derived and/or modified CDS sequence (AUadapt) from InfluenzaA__ADJ00501__HA

SEQ ID NO: 5390 - RNA, 1701 nt, Artificial Sequence; identical to SEQ ID NO: 4078
  derived and/or modified CDS sequence (AUadapt) from InfluenzaA__ADJ18163__HA

SEQ ID NO: 5391 - RNA, 1701 nt, Artificial Sequence; identical to SEQ ID NO: 4078
  derived and/or modified CDS sequence (AUadapt) from InfluenzaA__ADJ18165__HA

SEQ ID NO: 5392 - RNA, 1701 nt, Artificial Sequence
  derived and/or modified CDS sequence (AUadapt) from InfluenzaA__ADJ18167__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccguacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccgcgagggccggaugaacuacuacuggacccugguggagcccggggacaagaucaccuucgaggcgaccggcaaccucguggucccccgcuacgccuucgccauggagcggaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacaucccguccauccagucgcgcgggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgugaucgagaagaugaacacccaguucacggccgucggcaaggaguucaaccaccuggagaagcggaucgagaaccugaacaagaagguggacgacggcuuccucgacaucuggaccuacaacgccgagcugcugguccuccuggagaacgagcgcacccuggacuaccacgacucgaacgugaagaaccucuacgagaaggugcggucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgcgaggagaucgacggcgugaagcucgagucgacccggaucuaccagauccuggcgaucuacuccaccguggccagcucgcugguccucguggugucccugggggccaucagcuucuggaugugcuccaacggcagccugcagugccgcaucugcaucuga

SEQ ID NO: 5393 - RNA, 1701 nt, Artificial Sequence
  derived and/or modified CDS sequence (AUadapt) from InfluenzaA__ADJ18169__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccgcgagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggcgaucuacuccaccgucgccucgagccuggugcucguggucucccugggggccaucucguucuggaugugcuccaacggcagccugcagugccgcaucugcaucuga

SEQ ID NO: 5394 - RNA, 1701 nt, Artificial Sequence
  derived and/or modified CDS sequence (AUadapt) from InfluenzaA__ADJ18171__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgucguccuggcccuacaucguggagaccagcuccucggacaacggcacgugcuaccccggcgacuucaucgacuacgaggagcuccgggagcagcuguccagcguguccucguucgagcgcuucgagaucuuccccaagaccuccagcuggccgaaccacgacuccaacaagggggucaccgccgccugcccccacgccggcgccaagucguucuaccagaaccugaucuggcucgugaagaaggggaacuccuaccccaagcugagcaaguccuacauccacgacaagggcaaggaggugcugguccucugggggauccaccaccccucgaccagcgccgaccagcagucccuguaccagaacgccgacgccuacguguucgugggcacgucgcgguacuccaagaaguucaagccggagaucgccauccgccccaagguccgggaccgccagggccggaugaacuacuacuggacccugguggagcucggggacaagaucaccuucgaggcgaccggcaaccugguggucccccgcuacgccuucgccauggagcggaacgccgggagcggcaucaucaucuccgacacgcccgugcacaacugcaacacgaccugccagaccaccaccggcgccaucaacaccucgcugccguuccagaacauccaccccaucaccaucgggaagugccccaaguacgugaaguccacgaagcuccgccuggcgaccggccugcggaacguccccagcauccagucccgcggccucuucggggccaucgccggguucaucgagggcggcuggaccgggaugguggacggcugguacggguaccaccaccagaacgagcagggcucgggguacgccgccgaccugaaguccacccagaacgcgaucgacaagaucacgaacaaggugaacagcgucaucgagaagaugaacacccaguucaccgccgugggcaaggaguucaaccaccuggagaagcggaucgagaaccucaacaagaaggucgacgacggcuuccuggacaucuggaccuacaacgccgagcugcucgugcugcuggagaacgagcgcacgcucgacuaccacgacuccaacgugaagaaccuguacgagaagguccggucgcagcugaagaacaacgccaaggagaucgggaacggcugcuucgaguucuaccacaagugcgacaacacgugcauggaguccgugaagaacgggaccuacgacuacccgaaguacagcgaggaggccaagcucaaccgcgaggagaucgacggcgugaagcuggaguccacccggaucuaccagauccuggcgaucuacucgaccgucgccuccagccucgugcugguggucucgcugggggccaucuccuucuggaugugcagcaacggcucccuccagugccgcaucugcaucuga

SEQ ID NO: 5395 - RNA, 1701 nt, Artificial Sequence; identical to SEQ ID NO: 4078
  derived and/or modified CDS sequence (AUadapt) from InfluenzaA__ADJ18173__HA

SEQ ID NO: 5396 - RNA, 1701 nt, Artificial Sequence; identical to SEQ ID NO: 4078
  derived and/or modified CDS sequence (AUadapt) from InfluenzaA__ADJ18175__HA

SEQ ID NO: 5397 - RNA, 1701 nt, Artificial Sequence
  derived and/or modified CDS sequence (AUadapt) from InfluenzaA__ADJ18177__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccggggccaggaggggcgcaugaacuacuacuggacccugguggagcccggcgacaagaucaccuucgaggcgaccgggaaccucguggucccccgguacgccuucgccauggagcgcaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagucgaccaagcugcggcucgcgaccgggcugcgcaacaucccguccgugcagagccggggccuguucggggccaucgccggcuucaucgagggcggguggacgggcaugguggacgggugguacggcuaccaccaccagaacgagcagggguccggcuacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcucgagagcacccgcaucuaccagauccuggcgaucuacuccaccgucgccucgagccuggugcucguggucucccugggcgccaucucguucuggaugugcuccaacggcagccugcagugccggaucugcaucuga

SEQ ID NO: 5398 - RNA, 1701 nt, Artificial Sequence
  derived and/or modified CDS sequence (AUadapt) from InfluenzaA__ADJ40444__HA
augaaggccauccuggugguccuccuguacaccuucgccaccgcgaacgccgacacgcugugcaucggcuaccacgccaacaacucgaccgacaccguggacaccgugcucaagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 5399 - RNA, 1701 nt, Artificial Sequence
  derived and/or modified CDS sequence (AUadapt) from InfluenzaA__ADJ40454__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccggaaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacaucccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcguggagcucgagagcacccgcaucuaccagauccuggcgaucuacuccaccguggccucgagccugguccucguggugucccugggggccaucucguucuggaugugcuccaacggcagccugcagugccggaucugcaucuga

SEQ ID NO: 5400 - RNA, 1701 nt, Artificial Sequence
  derived and/or modified CDS sequence (AUadapt) from InfluenzaA__ADJ40464__HA
augaaggccauccuggugguccuccuguacaccuucgccaccgcgaacacggacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagacguccagcuccgacaacgggaccugcuaccccggcgacuucaucgacuacgaggagcuccgggagcagcugucguccgugagcuccuucgagcgcuucgagaucuuccccaagaccucguccuggcccaaccacgacagcaacaagggcgucaccgccgccugcccgcacgccggcgccaaguccuucuacaagaaccugaucuggcucgugaagaaggggaacucguaccccaagcuguccaagagcuacaucaacgacaagggcaaggaggugcugguccucugggggauccaccaccccucgacguccgcggaccagcagagccuguaccagaacgccgacgccuacguguucgugggcaccucccgguacucgaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcugauccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggccaucuacuccaccguggcgucgagccugguccucguggugucccugggggccaucucguucuggaugugcuccaacggcagccugcagugccggaucugcaucuga

SEQ ID NO: 5401 - RNA, 1701 nt, Artificial Sequence
  derived and/or modified CDS sequence (AUadapt) from InfluenzaA__ADJ40474__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagucgcuguaccagaacgccgacgccuacguguucgugggcacgucccgguacagcaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgagaagguccgccggcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgugaagcucgaguccacccggaucuaccagauccuggcgaucuacucgaccgucgccuccagccuggugcucguggucucgcugggggccaucuccuucuggaugugcagcaacggcucccugcagugccgcaucugcaucuga

SEQ ID NO: 5402 - RNA, 1701 nt, Artificial Sequence
  derived and/or modified CDS sequence (AUadapt) from InfluenzaA__ADJ40494__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccguggaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagacccugaucuggcucgugaagaaggggaacucguaccccaagcuguccaagagcuacaucaacgacaagggcaaggaggugcugguccucugggggauccaccaccccucgacguccgccgaccagcagagccuguaccagaacgccgacgccuacguguucgugggcaccucccgguacucgaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcggcucgcgacgggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagucgacccagaacgcgaucgacgagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 5403 - RNA, 1701 nt, Artificial Sequence
  derived and/or modified CDS sequence (AUadapt) from InfluenzaA__ADJ40514__HA
augaaggccgugcuggucgugcuccuguacaccuucgccaccacgaacgcggacacccugugcaucggcuaccacgccaacaacucgaccgacaccguggacacgguccucgagaagaacgugaccgugacccacuccgucaaccugcuggaggacaagcacaacgggaagcucugcaagcugcgcggcguggcgccccugcaccucgggaagugcaacaucgccggcuggauccuggggaacccggagugcgagucgcuguccaccgccagcuccuggucguacaucguggagacguccagcuccgacaacgggaccugcuaccccggcgacuucaucgacuacgaggagcuccgggagcagcugucguccgucagcuccuucgagcgcuucgagaucuuccccaagaccucguccuggcccaaccacgacagcaacaagggcgugaccgccgccugcccgcacgccggcgccaaguccuucuacaagaaccugaucuggcucgugaagaaggggaacucguaccccaagcuguccaagagcuacaucaacgacaagggcaaggagguccuggugcucugggggauccaccaccccucgacguccgcggaccagcagagccuguaccagaacgccgacgccuacguguucgucggcaccucccgguacucgaagaaguucaagcccgagaucgccauccgcccgaaggugcggaaccaggagggccgcaugaacuacuacuggacccugguggagcccggggacaagaucaccuucgaggccacgggcaaccucgucgugccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacgagaucaccaacaaggucaacuccgugaucgagaagaugaacacgcaguucaccgcggucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgucaagcucgagagcacccgcaucuaccagauccuggccaucuacuccaccguggcgucgagccuggugcucgucgugucccugggggccaucucguucuggaugugcuccaacggcagccugcagugccggaucugcaucuga

SEQ ID NO: 5404 - RNA, 1701 nt, Artificial Sequence; identical to SEQ ID NO: 116
  derived and/or modified CDS sequence (AUadapt) from InfluenzaA__ADJ40524__HA

SEQ ID NO: 5405 - RNA, 1701 nt, Artificial Sequence; identical to SEQ ID NO: 3267
  derived and/or modified CDS sequence (AUadapt) from InfluenzaA__ADJ40534__HA

SEQ ID NO: 5406 - RNA, 1701 nt, Artificial Sequence
  derived and/or modified CDS sequence (AUadapt) from InfluenzaA__ADJ40554__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaacaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 5407 - RNA, 1701 nt, Artificial Sequence; identical to SEQ ID NO: 116
  derived and/or modified CDS sequence (AUadapt) from InfluenzaA__ADJ40564__HA

SEQ ID NO: 5408 - RNA, 1701 nt, Artificial Sequence; identical to SEQ ID NO: 116
  derived and/or modified CDS sequence (AUadapt) from InfluenzaA__ADJ40574__HA

SEQ ID NO: 5409 - RNA, 1701 nt, Artificial Sequence; identical to SEQ ID NO: 4334
  derived and/or modified CDS sequence (AUadapt) from InfluenzaA__ADJ40584__HA

SEQ ID NO: 5410 - RNA, 1701 nt, Artificial Sequence; identical to SEQ ID NO: 116
  derived and/or modified CDS sequence (AUadapt) from InfluenzaA__ADJ40594__HA

SEQ ID NO: 5411 - RNA, 1701 nt, Artificial Sequence; identical to SEQ ID NO: 3483
  derived and/or modified CDS sequence (AUadapt) from InfluenzaA__ADJ40604__HA

SEQ ID NO: 5412 - RNA, 1701 nt, Artificial Sequence; identical to SEQ ID NO: 3483
  derived and/or modified CDS sequence (AUadapt) from InfluenzaA__ADJ40614__HA

SEQ ID NO: 5413 - RNA, 1701 nt, Artificial Sequence; identical to SEQ ID NO: 116
  derived and/or modified CDS sequence (AUadapt) from InfluenzaA__ADJ40634__HA

SEQ ID NO: 5414 - RNA, 1701 nt, Artificial Sequence; identical to SEQ ID NO: 116
  derived and/or modified CDS sequence (AUadapt) from InfluenzaA__ADJ40644__HA

SEQ ID NO: 5415 - RNA, 1701 nt, Artificial Sequence; identical to SEQ ID NO: 116
  derived and/or modified CDS sequence (AUadapt) from InfluenzaA__ADJ40654__HA

SEQ ID NO: 5416 - RNA, 1701 nt, Artificial Sequence; identical to SEQ ID NO: 116
  derived and/or modified CDS sequence (AUadapt) from InfluenzaA__ADJ40664__HA

SEQ ID NO: 5417 - RNA, 1701 nt, Artificial Sequence; identical to SEQ ID NO: 116
  derived and/or modified CDS sequence (AUadapt) from InfluenzaA__ADJ40674__HA

SEQ ID NO: 5418 - RNA, 1701 nt, Artificial Sequence
  derived and/or modified CDS sequence (AUadapt) from InfluenzaA__ADJ41816__HA
augaagaccaucaucgcccugucguacauguucugccucguguucgcccagaaccugcccggcaacgacaacuccaccgcgacgcugugccucgggcaccacgccgucccgaacggcacccuggugaagaccaucaccaacgaccagaucgaggugacgaacgccaccgagcugguccagagcuccucgaccgggcgcaucugcgacagcccccaccggauccucgacggcaagaacugcacccugaucgacgcccugcucggggacccccacugcgacggcuuccagaacgagaagugggaccuguucguggagcgcuccaaggccuucuccaacugcuaccccuacgacgugccggacuacgcgagccugcggucccucgucgccucguccggcacgcuggaguucaucaacgagggguucaacuggaccggcgugacccagagcgggggcuccugcacgugcaagcgcgggagcaacgacuccuucuucucgcggcugaacuggcucuacgaguccgagagcaaguaccccgugcugaacgucaccaugcccaacaacggcaaguucgacaagcuguacaucuggggcauccaccaccccuccaccgacaaggagcagaccaaccucuacauccgcgccagcgggcgggugaccgugucgacgaagcgcucccagcagaccgucaucccgaacaucggcagccggcccugggugcgcgggcuguccagccggaucuccaucuacuggaccaucgugaagcccggcgacauccugcucaucucguccaccggcaaccugaucgcgccccgcggguacuucaagauccggacgggcaagagcuccaucaugcgcagcgacgccccgaucgggaccugcuccucggagugcaucacccccaacggcuccauccccaacgacaagcccuuccagaacgucaacaagaucaccuacggggccugcccgcgguacgugaagcagaacacgcugaagcucgccaccggcaugcgcaacgugcccgagaagcagacccggggcaucuucggggccaucgccggcuucaucgagaacgggugggagggcauggucgacgggugguacggcuuccgccaccagaacagcgagggcaccgggcaggcggccgaccugaaguccacgcaggccgccaucgaccagaucaacggcaagcugaaccgggugaucgagaagaccaacgagaaguuccaccagaucgagaaggaguucagcgagguggaggggcgcauccaggaccucgagaaguacgucgaggacaccaagaucgaccugugguccuacaacgccgagcugcucguggcgcuggagaaccagcacaccaucgaccugacggacucggagaugaacaagcuguucgagaagacccggaagcagcuccgcgagaacgccgaggacaugggcaacgggugcuucaagaucuaccacaagugcgacaacgccugcaucggcuccauccgcaacggcaccuacgaccacgacguguaccgggacgaggcccugaacaaccgcuuccagaucaagggggucgagcucaagagcggcuacaaggacuggauccuguggaucagcuucgccaucuccugcuuccugcucugcgugguccugcugggguucaucaugugggcgugccagaagggcaacauccggugcaacaucugcaucuga

SEQ ID NO: 5419 - RNA, 1701 nt, Artificial Sequence; identical to SEQ ID NO: 116
  derived and/or modified CDS sequence (AUadapt) from InfluenzaA__ADJ56640__HA

SEQ ID NO: 5420 - RNA, 1701 nt, Artificial Sequence; identical to SEQ ID NO: 3712
  derived and/or modified CDS sequence (AUadapt) from InfluenzaA__ADJ56650__HA

SEQ ID NO: 5421 - RNA, 1701 nt, Artificial Sequence; identical to SEQ ID NO: 3005
  derived and/or modified CDS sequence (AUadapt) from InfluenzaA__ADJ67983__HA

SEQ ID NO: 5422 - RNA, 1701 nt, Artificial Sequence; identical to SEQ ID NO: 3005
  derived and/or modified CDS sequence (AUadapt) from InfluenzaA__ADJ67984__HA

SEQ ID NO: 5423 - RNA, 1701 nt, Artificial Sequence; identical to SEQ ID NO: 3005
  derived and/or modified CDS sequence (AUadapt) from InfluenzaA__ADJ67985__HA

SEQ ID NO: 5424 - RNA, 1701 nt, Artificial Sequence
  derived and/or modified CDS sequence (AUadapt) from InfluenzaA__ADJ80241__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccggaaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 5425 - RNA, 1701 nt, Artificial Sequence
  derived and/or modified CDS sequence (AUadapt) from InfluenzaA__ADJ80242__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgccgccucgagccugguccucguggugucccugggggccaucucguucuggaugugcuccaacggcagccugcagugccggaucugcaucuga

SEQ ID NO: 5426 - RNA, 1701 nt, Artificial Sequence; identical to SEQ ID NO: 4466
  derived and/or modified CDS sequence (AUadapt) from InfluenzaA__ADJ80243__HA

SEQ ID NO: 5427 - RNA, 1701 nt, Artificial Sequence; identical to SEQ ID NO: 116
  derived and/or modified CDS sequence (AUadapt) from InfluenzaA__ADJ80634__HA

SEQ ID NO: 5428 - RNA, 1701 nt, Artificial Sequence; identical to SEQ ID NO: 4916
  derived and/or modified CDS sequence (AUadapt) from InfluenzaA__ADJ80644__HA

SEQ ID NO: 5429 - RNA, 1701 nt, Artificial Sequence; identical to SEQ ID NO: 4916
  derived and/or modified CDS sequence (AUadapt) from InfluenzaA__ADJ80654__HA

SEQ ID NO: 5430 - RNA, 1701 nt, Artificial Sequence; identical to SEQ ID NO: 4078
  derived and/or modified CDS sequence (AUadapt) from InfluenzaA__ADJ80674__HA

SEQ ID NO: 5431 - RNA, 1701 nt, Artificial Sequence; identical to SEQ ID NO: 4078
  derived and/or modified CDS sequence (AUadapt) from InfluenzaA__ADJ80684__HA

SEQ ID NO: 5432 - RNA, 1701 nt, Artificial Sequence
  derived and/or modified CDS sequence (AUadapt) from InfluenzaA__ADJ80694__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaaccacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccagcuccgacaacggcacgugcuaccccggcgacuucaucgacuacgaggagcugcgggagcagcucucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcuggugaagaaggggaacucguaccccaagcucuccaagagcuacaucaacgacaagggcaaggaggugcugguccugugggggauccaccaccccucgaccuccgccgaccagcagagccucuaccagaacgccgacgccuacguguucgugggcuccucgcgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggagcggcaucaucaucuccgacacccccgugcacgacugcaacacgaccugccagaccccgaagggcgccaucaacaccucgcuccccuuccagaacauccaccccaucacgaucgggaagugccccaaguacgugaaguccaccaagcugcggcuggcgaccggccuccgcaacgucccgagcauccagucccgggggcuguucggcgccaucgccggguucaucgagggcggcuggaccgggaugguggacggcugguacggguaccaccaccagaacgagcagggcucgggguacgccgccgaccugaaguccacgcagaacgcgaucgacgagaucaccaacaaggugaacagcgucaucgagaagaugaacacccaguucaccgccgugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcucgcagcucaagaacaacgccaaggagguggggaacggcugcuucgaguucuaccacaagugcgacaacacgugcauggaguccgugaagaacgggaccuacgacuaccccaaguacagcgaggaggccaagcugaaccgggaggagaucgacggcgucaagcuggaguccacccgcaucuaccagauccucgcgaucuacucgaccgccgccagcucccuggugcugguggucucgcucggggccaucuccuucuggaugugcagcaacggcucccugcagugccggaucugcaucuga

SEQ ID NO: 5433 - RNA, 1701 nt, Artificial Sequence; identical to SEQ ID NO: 4078
  derived and/or modified CDS sequence (AUadapt) from InfluenzaA__ADJ80704__HA

SEQ ID NO: 5434 - RNA, 1701 nt, Artificial Sequence
  derived and/or modified CDS sequence (AUadapt) from InfluenzaA__ADJ80714__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgccgcgccccugcaccucgggaagugcaacaucgccggcuggauccuggggaacccggagugcgagucgcuguccaccgccagcuccuggucguacaucgucgagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggugaccgccgccugcccgcacgcgggcgccaaguccuucuacaagaaccugaucuggcucgucaagaaggggaacagcuaccccaagcuguccaagucguacaucaacgacaagggcaaggaggugcuggugcucugggggauccaccaccccagcaccuccgccgaccagcagucgcuguaccagaacgccgacgccuacgucuucgugggcacgucccgguacagcaagaaguucaagcccgagaucgcgauccgcccgaaggugcgggaccaggagggccgcaugaacuacuacuggacccuggucgagcccggggacaagaucaccuucgaggccaccggcaaccucguggugccccgguacgccuucgccauggagcgcaacgccggguccggcaucaucaucucggacacgcccguccacgacugcaacacgaccugccagaccccgaagggcgcgaucaacaccucccugcccuuccagaacauccaccccaucaccaucgggaagugccccaaguacgucaagagcaccaagcugcggcucgccaccggccugcgcaacgugccguccauccagucgcgggggcuguucggcgccaucgccggguucaucgagggcggcuggacggggaugguggacggcugguacggguaccaccaccagaacgagcagggcuccggguacgccgcggaccucaagucgacccagaacgccaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggcgaagcugaaccgggaggagaucgacggcgugaagcucgagagcacccgcaucuaccagauccuggccaucuacuccaccguggccucgagccugguccucguggugucccugggggccaucucguucuggaugugcuccaacggcagccugcagugccggaucugcaucuga

SEQ ID NO: 5435 - RNA, 1701 nt, Artificial Sequence; identical to SEQ ID NO: 116
  derived and/or modified CDS sequence (AUadapt) from InfluenzaA__ADJ80724__HA

SEQ ID NO: 5436 - RNA, 1701 nt, Artificial Sequence; identical to SEQ ID NO: 4078
  derived and/or modified CDS sequence (AUadapt) from InfluenzaA__ADJ80734__HA

SEQ ID NO: 5437 - RNA, 1701 nt, Artificial Sequence; identical to SEQ ID NO: 4078
  derived and/or modified CDS sequence (AUadapt) from InfluenzaA__ADJ80744__HA

SEQ ID NO: 5438 - RNA, 1701 nt, Artificial Sequence; identical to SEQ ID NO: 4078
  derived and/or modified CDS sequence (AUadapt) from InfluenzaA__ADJ80754__HA

SEQ ID NO: 5439 - RNA, 1701 nt, Artificial Sequence
  derived and/or modified CDS sequence (AUadapt) from InfluenzaA__ADJ80774__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagucgcuguccaccgcgaacagcugguccuacaucguggagaccucguccagcgacaacggcacgugcuaccccggcgacuucaucgacuacgaggagcugcgggagcagcucuccucgguguccagcuucgagcgcuucgagaucuuccccaagaccuccucguggcccaaccacgacuccaacaagggggucaccgccgccugcccgcacgccggcgccaagucguucuacaagaaccugaucuggcuggugaagaaggggaacuccuaccccaagcucagcaaguccuacaucaacgacaagggcaaggaggugcugguccugugggggauccaccaccccucgaccagcgccgaccagcagucccucuaccagaacgccgacgccuacguguucgugggcucgucccgguacagcaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccggguccggcaucaucaucucggacacccccgugcacgacugcaacacgaccugccagaccccgaagggcgccaucaacaccucccuccccuuccagaacauccaccccaucacgaucgggaagugccccaaguacgucaagagcaccaagcugcggcuggcgaccggccuccgcaacgugccguccauccagucgcgggggcuguucggcgccaucgccggguucaucgagggcggcuggaccgggaugguggacggcugguacggguaccaccaccagaacgagcagggcuccggguacgccgccgaccucaagucgacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccuggacaucuggacguacaacgccgagcuccuggugcugcucgagaacgagcggacccuggacuaccacgacagcaacgugaagaaccuguacgagaagguccgcucccagcucaagaacaacgccaaggagguggggaacggcugcuucgaguucuaccacaagugcgacaacacgugcauggagucggugaagaacgggaccuacgacuaccccaaguacuccgaggaggccaagcugaaccgggaggagaucgacggcgucaagcuggagagcacccgcaucuaccagauccucgcgaucuacuccaccgccgccucgagccuggugcugguggucucccucggggccaucucguucuggaugugcuccaacggcagccugcagugccggaucugcaucuga

SEQ ID NO: 5440 - RNA, 1701 nt, Artificial Sequence
  derived and/or modified CDS sequence (AUadapt) from InfluenzaA__ADJ80784__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccacaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 5441 - RNA, 1701 nt, Artificial Sequence; identical to SEQ ID NO: 4078
  derived and/or modified CDS sequence (AUadapt) from InfluenzaA__ADJ80794__HA

SEQ ID NO: 5442 - RNA, 1701 nt, Artificial Sequence; identical to SEQ ID NO: 4916
  derived and/or modified CDS sequence (AUadapt) from InfluenzaA__ADJ80804__HA

SEQ ID NO: 5443 - RNA, 1701 nt, Artificial Sequence
  derived and/or modified CDS sequence (AUadapt) from InfluenzaA__ADJ80814__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcgggccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgcuacucgaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccaucgagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggcgaucuacuccaccgucgccucgagccuggugcucguggucucccugggggccaucucguucuggaugugcuccaacggcagccugcagugccgcaucugcaucuga

SEQ ID NO: 5444 - RNA, 1701 nt, Artificial Sequence
  derived and/or modified CDS sequence (AUadapt) from InfluenzaA__ADJ80834__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccacggaccagcagagccuguaccagaacgccgacgccuacguguucgugggcaccucccgguacucgaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacuccgggagcggcaucaucaucuccgacacccccgugcacuacugcaacacgaccugccagaccccgaagggcgccaucaacaccucgcugcccuuccagaacauccaccccaucaccaucgggaagugccccaaguacgugaaguccaccaagcugcggcucgccacgggccugcgcaacgucccgagcauccagucccgggggcuguucggcgccaucgcgggguucaucgagggcggcuggaccgggaugguggacggcugguacggguaccaccaccagaacgagcagggcagcggguacgccgccgaccucaaguccacccagaacgccaucgacgagaucaccaacaaggugaacucggucaucgagaagaugaacacgcaguucaccgccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggccaucuacagcaccgucgccucgucccuggugcucguggucagccugggggcgaucuccuucuggaugugcagcaacggcucccugcagugccggaucugcaucuga

SEQ ID NO: 5445 - RNA, 1701 nt, Artificial Sequence; identical to SEQ ID NO: 5116
  derived and/or modified CDS sequence (AUadapt) from InfluenzaA__ADJ80848__HA

SEQ ID NO: 5446 - RNA, 1701 nt, Artificial Sequence
  derived and/or modified CDS sequence (AUadapt) from InfluenzaA__ADJ80858__HA
augaagaccauccuggugguccuccuguacaccuucgccacggccaacgcggacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagacguccagcuccgacaacgggaccugcuaccccggcgacuucaucgacuacgaggagcuccgggagcagcugucguccgugagcuccuucgagcgcuucgagaucuuccccaagaccucguccuggcccaaccacgacagcaacaagggcgucaccgccgccugcccgcacgccggcgccaaguccuucuacaagaaccugaucuggcucgugaagaaggggaacucguaccccaagcuguccaagagcuacaucaacgacaagggcaaggaggugcugguccucugggggauccaccaccccucgacguccgcggaccagcagagccuguaccagaacgccgacgccuacguguucgugggcaccucccgguacucgaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacaagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggccaucuacuccaccgucgcgucgagccuggugcucguggucucccugggggccaucucguucuggaugugcuccaacggcagccugcagugccggaucugcaucuga

SEQ ID NO: 5447 - RNA, 1701 nt, Artificial Sequence
  derived and/or modified CDS sequence (AUadapt) from InfluenzaA__ADJ80868__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgaacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccgggggcaagaucaccuucgaggcgaccgggaaccucguggucccccgguacgccuucgccauggagcgcaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagucgaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcucgagagcacccgcaucuaccagauccuggcgaucuacuccaccgucgccucgagccuggugcucguggucucccugggcgccaucucguucuggaugugcuccaacggcagccugcagugccggaucugcaucuga

SEQ ID NO: 5448 - RNA, 1701 nt, Artificial Sequence; identical to SEQ ID NO: 4078
  derived and/or modified CDS sequence (AUadapt) from InfluenzaA__ADJ80883__HA

SEQ ID NO: 5449 - RNA, 1701 nt, Artificial Sequence; identical to SEQ ID NO: 4078
  derived and/or modified CDS sequence (AUadapt) from InfluenzaA__ADJ80893__HA

SEQ ID NO: 5450 - RNA, 1701 nt, Artificial Sequence; identical to SEQ ID NO: 4078
  derived and/or modified CDS sequence (AUadapt) from InfluenzaA__ADJ80910__HA

SEQ ID NO: 5451 - RNA, 1701 nt, Artificial Sequence; identical to SEQ ID NO: 116
  derived and/or modified CDS sequence (AUadapt) from InfluenzaA__ADJ80927__HA

SEQ ID NO: 5452 - RNA, 1701 nt, Artificial Sequence
  derived and/or modified CDS sequence (AUadapt) from InfluenzaA__ADJ80937__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacgccuucgugggcacgucccgguacucgaagaaguucaagcccgagaucgcgauccgcccgaaggugcgggaccaggagggccgcaugaacuacuacuggacccuggucgagcccggggacaagaucaccuucgaggccaccggcaaccucguggugccccgguacgccuucgccauggagcgcaacgccggguccggcaucaucaucagcgacacgcccguccacaacugcaacacgaccugccagaccccgaagggcgcgaucaacaccucccugcccuuccagaacauccaccccaucaccaucgggaagugccccaaguacgucaagucgaccaagcugcggcucgccaccggccugcgcaacgugccguccauccagagccgggggcuguucggcgccaucgccggguucaucgagggcggcuggacggggaugguggacggcugguacggguaccaccaccagaacgagcagggcuccggguacgccgcggaccucaagucgacccagaacgccaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagucccucuacgagaaggugcgcucgcagcugaagaacaacgccaaggagaucgggaacggcugcuucgaguucuaccacaagugcgacaacacgugcauggaguccgucaagaacgggaccuacgacuaccccaaguacagcgaggaggcgaagcugaaccgggaggagaucgacggcgugaagcucgaguccacccgcaucuaccagauccuggccaucuacucgaccguggccagcucccugguccucguggugucgcugggggccaucuccuucuggaugugcagcaacggcucccugcagugccggaucugcaucuga

SEQ ID NO: 5453 - RNA, 1701 nt, Artificial Sequence; identical to SEQ ID NO: 4078
  derived and/or modified CDS sequence (AUadapt) from InfluenzaA__ADJ80947__HA

SEQ ID NO: 5454 - RNA, 1701 nt, Artificial Sequence; identical to SEQ ID NO: 4078
  derived and/or modified CDS sequence (AUadapt) from InfluenzaA__ADJ80967__HA

SEQ ID NO: 5455 - RNA, 1701 nt, Artificial Sequence; identical to SEQ ID NO: 4078
  derived and/or modified CDS sequence (AUadapt) from InfluenzaA__ADJ80977__HA

SEQ ID NO: 5456 - RNA, 1701 nt, Artificial Sequence
  derived and/or modified CDS sequence (AUadapt) from InfluenzaA__ADJ80993__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgaacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 5457 - RNA, 1701 nt, Artificial Sequence
  derived and/or modified CDS sequence (AUadapt) from InfluenzaA__ADJ81003__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggagaagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 5458 - RNA, 1701 nt, Artificial Sequence; identical to SEQ ID NO: 5116
  derived and/or modified CDS sequence (AUadapt) from InfluenzaA__ADJ81013__HA

SEQ ID NO: 5459 - RNA, 1701 nt, Artificial Sequence
  derived and/or modified CDS sequence (AUadapt) from InfluenzaA__ADJ81023__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagauguuccccaagaccucguccuggcccaaccacgacagcaacaagggggucaccgccgccugcccgcacgccggcgcgaaguccuucuacaagaaccugaucuggcucgugaagaaggggaacucguaccccaagcugaacaaguccuacaucaacgacaagggcaaggaggugcugguccucugggggauccaccaccccagcaccucggccgaccagcagucccuguaccagaacgccgacgccuacguguucgugggcacgucgcgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccucgcugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcucgggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 5460 - RNA, 1701 nt, Artificial Sequence; identical to SEQ ID NO: 4078
  derived and/or modified CDS sequence (AUadapt) from InfluenzaA__ADJ81033__HA

SEQ ID NO: 5461 - RNA, 1701 nt, Artificial Sequence; identical to SEQ ID NO: 116
  derived and/or modified CDS sequence (AUadapt) from InfluenzaA__ADJ81043__HA

SEQ ID NO: 5462 - RNA, 1701 nt, Artificial Sequence
  derived and/or modified CDS sequence (AUadapt) from InfluenzaA__ADJ81053__HA
augaaggccauccuggugguccuccuguacaccuucaccacggccaacgcggacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagacguccagcuccgacaacgggaccugcuaccccggcgacuucaucgacuacgaggagcuccgggagcagcugucguccgugagcuccuucgagcgcuucgagaucuuccccaagaccucguccuggcccaaccacgacagcaacaagggcgucaccgccgccugcccgcacgccggcgccaaguccuucuacaagaaccugaucuggcucgugaagaaggggaacucguaccccaagcuguccaagagcuacaucaacgacaagggcaaggaggugcugguccucugggggauccaccaccccucgacguccgcggaccagcagagccuguaccagaacgccgacgccuacguguucgugggcaccucccgguacucgaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacaagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggccaucuacuccaccgucgcgucgagccuggugcucguggucucccugggggccaucucguucuggaugugcuccaacggcagccugcagugccggaucugcaucuga

SEQ ID NO: 5463 - RNA, 1701 nt, Artificial Sequence; identical to SEQ ID NO: 4078
  derived and/or modified CDS sequence (AUadapt) from InfluenzaA__ADJ81063__HA

SEQ ID NO: 5464 - RNA, 1701 nt, Artificial Sequence; identical to SEQ ID NO: 3858
  derived and/or modified CDS sequence (AUadapt) from InfluenzaA__ADJ84772__HA

SEQ ID NO: 5465 - RNA, 1701 nt, Artificial Sequence
  derived and/or modified CDS sequence (AUadapt) from InfluenzaA__ADJ88782__HA
augaagaccaucaucgcccugucguacaugcucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucaucgccagcuccggcacgcuggaguucaacaacgagucguucaacuggaccggggucacccagaacggcaccuccucggccugcauccgccgguccaacaacagcuucuucucccgccugaacuggcucacgcaccugaaguucaaguaccccgcccugaacgugaccaugcccaacaacgagcaguucgacaagcucuacaucuggggcgugcaccaccccgggaccgacaacgaccagaucuuccuguacgcgcaggccucggggcggaucaccgucuccacgaagcgcagccagcagaccgugaucccgaacaucggcucgcggccccgcgugcggaacauccccucccgcaucagcaucuacuggaccaucgucaagcccggcgacauccugcucaucaacuccaccgggaaccugaucgccccgcggggcuacuucaagauccgcucggggaaguccucgaucaugcgguccgacgcccccaucggcaagugcaacagcgagugcaucacgcccaacggcuccauccccaacgacaagccguuccagaacgugaaccgcaucaccuacggggccugcccccgguacgugaagcagaacacccugaagcucgcgaccggcaugcgcaacguccccgagaagcagacgcgggggaucuucggcgccaucgccggguucaucgagaacggcugggagggcaugguggacgggugguacggcuuccgccaccagaacucggaggggcggggccaggccgccgaccugaaguccacccaggcggccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacacgaucgaccucaccgacucggagaugaacaagcuguucgagaagaccaagaagcagcugggggagaacgccgaggacaugggcaacgggugcuucaagaucuaccacaagugcgacaacgcgugcaucggcuccauccgcaacgggaccuacgaccacgacguguaccgcgacgaggcccucaacaaccgguuccagaucaagggcgucgagcugaaguccggcuacaaggacuggauccuguggaucuccuucgccaucagcugcuuccuccugugcguggcccugcucggguucaucaugugggccugccagaagggcaacauccgcugcaacaucugcaucuga

SEQ ID NO: 5466 - RNA, 1701 nt, Artificial Sequence
  derived and/or modified CDS sequence (AUadapt) from InfluenzaA__ADK21733__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccacggaccagcagucgcuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucucggacacccccgcccacgacugcaacacgaccugccagaccccgaagggcgccaucaacaccucccugcccuuccagaacauccaccccaucaccaucgggaagugccccaaguacgucaagagcaccaagcugcggcucgcgacgggccugcgcaacgugccguccauccagucgcgggggcuguucggcgccaucgccggguucaucgagggcggcuggaccgggaugguggacggcugguacggguaccaccaccagaacgagcagggcuccggguacgccgccgaccucaagucgacccagaacgcgaucgacaagaucaccaacaaggugaacuccgugaucgagaagaugaacacgcaguucaccgccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgagccugguccucguggugucccugggggccaucucguucuggaugugcuccaacggcagccugcagugccggaucugcaucuga

SEQ ID NO: 5467 - RNA, 1701 nt, Artificial Sequence
  derived and/or modified CDS sequence (AUadapt) from InfluenzaA__ADK21743__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggucaccgccgccugcccgcacgccggcgcgaaguccuucuacaagaaccugaucuggcucgugaagaaggggaacagcuaccccaagaucuccaacucguacaucaacgacaagggcaaggaggugcugguccugugggggauccaccaccccagcaccuccgccgaccagcagucgcucuaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucgccauggagcgcaacgccggguccggcaucaucaucucggacacgcccgcccacgacugcaacacgaccugccagaccccgaagggcgcgaucaacaccucccuccccuuccagaacauccaccccaucaccaucgggaagugccccaaguacgucaagagcaccaagcugcggcuggccaccggccuccgcaacgugccguccauccagucgcgggggcuguucggcgccaucgccggguucaucgagggcggcuggacggggaugguggacggcugguacggguaccaccaccagaacgagcagggcuccggguacgccgcggaccucaagucgacccagaacgccaucgacgagaucaccaacaaggugaacuccgugaucgagaagaugaacacccaguucacggccgucggcaaggaguucaaccaccuggagaagcgcaucgagaaccugaacaagaagguggacgacggcuuccuggacaucuggaccuacaacgccgagcuccugguccugcucgagaacgagcggacccuggacuaccacgacagcaacgugaagaaccuguacgagaaggugcgcucccagcucaagaacaacgccaaggagaucgggaacggcugcuucgaguucuaccacaagugcgacaacacgugcauggagucggucaagaacgggaccuacgacuaccccaaguacuccgaggaggcgaagcugaaccgggaggagaucgacggcgugaagcuggagagcacccgcaucuaccagauccucgccaucuacuccaccguggccucgagccugguccugguggugucccucggggccaucucguucuggaugugcuccaacggcagccugcagugccggaucugcaucuga

SEQ ID NO: 5468 - RNA, 1701 nt, Artificial Sequence
  derived and/or modified CDS sequence (AUadapt) from InfluenzaA__ADK21753__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggaggggaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagucgaccaagcugcgccucgcgaccgggcugcggaacgugccguccauccagagccgcggccuguucggggccaucgccggcuucaucgagggcggguggacgggcaugguggacgggugguacggcuaccaccaccagaacgagcagggguccggcuacgccgccgaccucaagucgacccagaacgcgaucgacaagaucaccaacaaggugaacuccgucaucgagaagaugaacacccaguucacggccgugggcaaggaguucaaccaccuggagaagcggaucgagaaccugaacaagaaggucgacgacggguuccucgacaucuggaccuacaacgccgagcugcuggugcuccuggagaacgagcgcacccuggacuaccacgacagcaacgugaagaaccucuacgagaagguccggucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgcgaggagaucgacggggugaagcucgagagcacccggaucuaccagauccuggcgaucuacuccaccgucgccucgagccuggugcucguggucucccugggcgccaucucguucuggaugugcuccaacggcagccugcagugccgcaucugcaucuga

SEQ ID NO: 5469 - RNA, 1701 nt, Artificial Sequence
  derived and/or modified CDS sequence (AUadapt) from InfluenzaA__ADK21763__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacguccaaguacucgaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggcgaucuacuccaccgucgccucgagccuggugcucguggucucccugggggccaucucguucuggaugugcuccaacggcagccugcagugccgcaucugcaucuga

SEQ ID NO: 5470 - RNA, 1701 nt, Artificial Sequence; identical to SEQ ID NO: 4078
  derived and/or modified CDS sequence (AUadapt) from InfluenzaA__ADK21773__HA

SEQ ID NO: 5471 - RNA, 1701 nt, Artificial Sequence; identical to SEQ ID NO: 4078
  derived and/or modified CDS sequence (AUadapt) from InfluenzaA__ADK21783__HA

SEQ ID NO: 5472 - RNA, 1701 nt, Artificial Sequence; identical to SEQ ID NO: 116
  derived and/or modified CDS sequence (AUadapt) from InfluenzaA__ADK21813__HA

SEQ ID NO: 5473 - RNA, 1701 nt, Artificial Sequence; identical to SEQ ID NO: 4334
  derived and/or modified CDS sequence (AUadapt) from InfluenzaA__ADK21823__HA

SEQ ID NO: 5474 - RNA, 1701 nt, Artificial Sequence
  derived and/or modified CDS sequence (AUadapt) from InfluenzaA__ADK21833__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcgggacugcaacacgaccugccagaccccgaagggcgccaucaacaccucccugcccuuccagaacauccaccccaucaccaucgggaagugccccaaguacgucaagucgaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggcgaucuacuccaccgucgccucgagccuggugcucguggucucccugggggccaucucguucuggaugugcuccaacggcagccugcagugccgcaucugcaucuga

SEQ ID NO: 5475 - RNA, 1701 nt, Artificial Sequence; identical to SEQ ID NO: 4078
  derived and/or modified CDS sequence (AUadapt) from InfluenzaA__ADK21843__HA

SEQ ID NO: 5476 - RNA, 1701 nt, Artificial Sequence; identical to SEQ ID NO: 3267
  derived and/or modified CDS sequence (AUadapt) from InfluenzaA__ADK21853__HA

SEQ ID NO: 5477 - RNA, 1701 nt, Artificial Sequence; identical to SEQ ID NO: 4563
  derived and/or modified CDS sequence (AUadapt) from InfluenzaA__ADK21863__HA

SEQ ID NO: 5478 - RNA, 1701 nt, Artificial Sequence; identical to SEQ ID NO: 3361
  derived and/or modified CDS sequence (AUadapt) from InfluenzaA__ADK21873__HA

SEQ ID NO: 5479 - RNA, 1701 nt, Artificial Sequence
  derived and/or modified CDS sequence (AUadapt) from InfluenzaA__ADK21883__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucgugguccccaaguacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcgccucgcgaccggccugcggaacaucccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgugaucgagaagaugaacacccaguucacggccgucggcaaggaguucaaccaccuggagaagcggaucgagaaccugaacaagaagguggacgacggcuuccucgacaucuggaccuacaacgccgagcugcugguccuccuggagaacgagcgcacccuggacuaccacgacagcaacgugaagaaccucuacgagaaggugcggucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgcgaggagaucgacggcgugaagcucgagagcacccggaucuaccagauccuggcgaucuacuccaccguggccucgagccugguccucguggugucccugggggccaucucguucuggaugugcuccaacggcagccugcagugccgcaucugcaucuga

SEQ ID NO: 5480 - RNA, 1701 nt, Artificial Sequence; identical to SEQ ID NO: 116
  derived and/or modified CDS sequence (AUadapt) from InfluenzaA__ADK21893__HA

SEQ ID NO: 5481 - RNA, 1701 nt, Artificial Sequence; identical to SEQ ID NO: 4511
  derived and/or modified CDS sequence (AUadapt) from InfluenzaA__ADK21903__HA

SEQ ID NO: 5482 - RNA, 1701 nt, Artificial Sequence; identical to SEQ ID NO: 4624
  derived and/or modified CDS sequence (AUadapt) from InfluenzaA__ADK21913__HA

SEQ ID NO: 5483 - RNA, 1701 nt, Artificial Sequence
  derived and/or modified CDS sequence (AUadapt) from InfluenzaA__ADK21923__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccagcuccgacaacggcacgugcuaccccggcgacuucaucgacuacgaggagcugcgggagcagcucucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcuggugaagaaggggaacagcuaccccaagcucuccaagucguacaucaacgacaagggcaaggaggugcugguccugugggggauccaccaccccagcaccuccgccgaccagcagucgcucuaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucgccauggagcgcaacgccggguccggcaucaucaucagcgacacgcccgugcacgacugcaacacgaccugccagaccccgaagggcgccaucaacaccucccuccccuuccagaacauccaccccaucaccaucgggaagugccccaaguacgucaagucgaccaagcugcggcuggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacucgaacgugaagaaccuguacgagaaggcccgcucccagcucaagaacaacgccaaggagaucgggaacggcugcuucgaguucuaccacaagugcgacaacacgugcauggagagcgucaagaacgggaccuacgacuaccccaaguacuccgaggaggcgaagcugaaccgggagaagaucgacggcgugaagcuggagucgacccgcaucuaccagauccucgccaucuacuccaccguggccagcacccugguccugguggugucgcucggggccaucuccuucuggaugugcagcaacggcucccugcagugccggaucugcaucuga

SEQ ID NO: 5484 - RNA, 1701 nt, Artificial Sequence
  derived and/or modified CDS sequence (AUadapt) from InfluenzaA__ADK21933__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccguggaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgaacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 5485 - RNA, 1701 nt, Artificial Sequence; identical to SEQ ID NO: 116
  derived and/or modified CDS sequence (AUadapt) from InfluenzaA__ADK21943__HA

SEQ ID NO: 5486 - RNA, 1701 nt, Artificial Sequence
  derived and/or modified CDS sequence (AUadapt) from InfluenzaA__ADK21953__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgaccacgaggagcuccgggagcagcugucguccgugagcuccuucgagcgcuucgagaucuuccccaagaccucguccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggccauccaccaccccagcaccuccgccgaccagcagucgcuguaccagaacgccgacgccuacguguucguggggacgucccgguacagcaagaaguucaagcccgagaucgcgauccgcccgaagguccgggaccaggagggccgcaugaacuacuacuggacccugguggagcccggcgacaagaucaccuucgaggccaccgggaaccucguggucccccgguacgccuucgccauggagcgcaacgccggcuccgggaucaucaucucggacacgcccgugcacgacugcaacacgaccugccagaccccgaagggcgcgaucaacaccucccugcccuuccagaacauccaccccaucaccaucggcaagugccccaaguacgucaagagcaccaagcugcggcucgccaccgggcugcgcaacgugccguccauccagucgcggggccuguucggggccaucgccggcuucaucgagggcggguggacgggcaugguggacgggugguacggcuaccaccaccagaacgagcagggguccggcuacgccgcggaccucaagucgacccagaacgccaucgacgagaucaccaacaaggugaacuccgucaucgagaagaugaacacccaguucacggccguggggaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagucggugaagaacggcaccuacgacuaccccaaguacuccgaggaggcgaagcugaaccgggaggagaucgacggggugaagcucgagagcacccgcaucuaccagauccuggccaucuacuccaccgucgccucgagccuggugcucguggucucccugggcgccaucucguucuggaugugcuccaacgggagccugcagugccggaucugcaucuga

SEQ ID NO: 5487 - RNA, 1701 nt, Artificial Sequence; identical to SEQ ID NO: 5101
  derived and/or modified CDS sequence (AUadapt) from InfluenzaA__ADK32390__HA

SEQ ID NO: 5488 - RNA, 1701 nt, Artificial Sequence; identical to SEQ ID NO: 5101
  derived and/or modified CDS sequence (AUadapt) from InfluenzaA__ADK32400__HA

SEQ ID NO: 5489 - RNA, 1701 nt, Artificial Sequence
  derived and/or modified CDS sequence (AUadapt) from InfluenzaA__ADK32420__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccacucgaucaccaucgggaagugccccaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcucgggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagucggugaagaacgggaccuacgacuacccgaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 5490 - RNA, 1701 nt, Artificial Sequence; identical to SEQ ID NO: 4466
  derived and/or modified CDS sequence (AUadapt) from InfluenzaA__ADK32430__HA

SEQ ID NO: 5491 - RNA, 1701 nt, Artificial Sequence
  derived and/or modified CDS sequence (AUadapt) from InfluenzaA__ADK32440__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacggcaucaccaacaaggugaacuccgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcucgagagcacccgcaucuaccagauccuggcgaucuacuccaccgucgccucgagccuggugcucguggucucccugggcgccaucucguucuggaugugcuccaacggcagccugcagugccggaucugcaucuga

SEQ ID NO: 5492 - RNA, 1701 nt, Artificial Sequence
  derived and/or modified CDS sequence (AUadapt) from InfluenzaA__ADK32450__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccagcuccgacaacggcacgugcuaccccggcgacuucaucgacuacgaggagcugcgggagcagcucucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcuggugaagaaggggaacucguaccccaagcucuccaagagcuacaucaacgacaagggcaaggaggugcugguccugugggggauccaccaccccucgaccuccgccgaccagcagagccucuaccagaacgccgacgccuacguguucgugggcuccucgcgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggagcggcaucaucaucuccgacgcccccgugcacgacugcaacaccacgugccagaccccgaagggcgcgaucaacaccucgcuccccuuccagaacauccaccccaucaccaucgggaagugccccaaguacgugaaguccacgaagcugcggcuggccaccggccuccgcaacgucccgagcauccagucccgggggcuguucggcgccaucgccggguucaucgagggcggcuggaccgggaugguggacggcugguacggguaccaccaccagaacgagcagggcucgggguacgccgcggaccugaaguccacccagaacgccaucgacgagaucacgaacaaggugaacagcgucaucgagaagaugaacacccaguucaccgccgugggcaaggaguucaaccaccucgagaagcgcaucgagaaccugaacaagaaggucgacgacggcuuccuggacaucuggaccuacaacgccgagcuccuggugcugcucgagaacgagcggacgcuggacuaccacgacuccaacgugaagaaccuguacgagaagguccgcucgcagcucaagaacaacgccaaggagguggggaacggcugcuucgaguucuaccacaagugcgacaacacgugcauggaguccgugaagaacgggaccuacgacuaccccaaguacagcgaggaggcgaagcugaaccgggaggagaucgacggcgucaagcuggaguccacccgcaucuaccagauccucgccaucuacucgaccgccgccagcucccuggugcugguggucucgcucggggcgaucuccuucuggaugugcagcaacggcucccugcagugccggaucugcaucuga

SEQ ID NO: 5493 - RNA, 1701 nt, Artificial Sequence
  derived and/or modified CDS sequence (AUadapt) from InfluenzaA__ADK32460__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacgccuucgugggcacgucccgguacagcaagaaguucaagcccgagaucgcgauccgcccgaaggugcgggaccaggagggccgcaugaacuacuacuggacccuggucgagcccggggacaagaucaccuucgaggccaccggcaaccucguggugccccgguacgccuucgccauggagcgcaacgccggguccggcaucaucaucucggacacgcccguccacgacugcaacacgaccugccagaccccgaagggcgcgaucaacaccucccugcccuuccagaacauccaccccaucaccaucgggaagugccccaaguacgucaagagcaccaagcugcggcucgccaccggccugcgcaacgugccguccauccagucgcgggggcuguucggcgccaucgccggguucaucgagggcggcuggacggggaugguggacggcugguacggguaccaccaccagaacgagcagggcuccggguacgccgcggaccucaagucgacccagaacgccaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggcgaagcugaaccgggaggagaucgacggcgugaagcucgagagcacccgcaucuaccagauccuggccaucuacuccaccguggccucgagccugguccucguggugucccugggggccaucucguucuggaugugcuccaacggcagccugcagugccggaucugcaucuga

SEQ ID NO: 5494 - RNA, 1701 nt, Artificial Sequence; identical to SEQ ID NO: 4078
  derived and/or modified CDS sequence (AUadapt) from InfluenzaA__ADK32470__HA

SEQ ID NO: 5495 - RNA, 1701 nt, Artificial Sequence
  derived and/or modified CDS sequence (AUadapt) from InfluenzaA__ADK32480__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgcccacgacugcaacacgaccugccagaccccgaagggcgcgaucaacaccucccugcccuuccagaacauccaccccaucaccaucgggaagugccccaaguacgucaagagcaccaagcugcggcucgccaccggccugcgcaacgugccguccauccagucgcgggggcuguucggcgccaucgccggguucaucgagggcggcuggacggggaugguggacggcugguacggguaccaccaccagaacgagcagggcuccggguacgccgcggaccucaagucgacccagaacgccaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggcgaagcugaaccgggaggagaucgacggcgugaagcucgagagcacccgcaucuaccagauccuggccaucuacuccaccguggccucgagccugguccucguggugucccugggggccaucucguucuggaugugcuccaacggcagccugcagugccggaucugcaucuga

SEQ ID NO: 5496 - RNA, 1701 nt, Artificial Sequence; identical to SEQ ID NO: 4078
  derived and/or modified CDS sequence (AUadapt) from InfluenzaA__ADK32490__HA

SEQ ID NO: 5497 - RNA, 1701 nt, Artificial Sequence; identical to SEQ ID NO: 4078
  derived and/or modified CDS sequence (AUadapt) from InfluenzaA__ADK32502__HA

SEQ ID NO: 5498 - RNA, 1701 nt, Artificial Sequence; identical to SEQ ID NO: 4550
  derived and/or modified CDS sequence (AUadapt) from InfluenzaA__ADK32637__HA

SEQ ID NO: 5499 - RNA, 1701 nt, Artificial Sequence; identical to SEQ ID NO: 4078
  derived and/or modified CDS sequence (AUadapt) from InfluenzaA__ADK32647__HA

SEQ ID NO: 5500 - RNA, 1701 nt, Artificial Sequence; identical to SEQ ID NO: 4242
  derived and/or modified CDS sequence (AUadapt) from InfluenzaA__ADK32657__HA

SEQ ID NO: 5501 - RNA, 1701 nt, Artificial Sequence; identical to SEQ ID NO: 4466
  derived and/or modified CDS sequence (AUadapt) from InfluenzaA__ADK32677__HA

SEQ ID NO: 5502 - RNA, 1701 nt, Artificial Sequence
  derived and/or modified CDS sequence (AUadapt) from InfluenzaA__ADK32687__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaagaacuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacguguucgugggcacgucgcgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccucgcugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcucgggguacgccgccgaccucaaguccacccagaacgcgaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 5503 - RNA, 1701 nt, Artificial Sequence; identical to SEQ ID NO: 4705
  derived and/or modified CDS sequence (AUadapt) from InfluenzaA__ADK32697__HA

SEQ ID NO: 5504 - RNA, 1701 nt, Artificial Sequence; identical to SEQ ID NO: 4078
  derived and/or modified CDS sequence (AUadapt) from InfluenzaA__ADK32776__HA

SEQ ID NO: 5505 - RNA, 1701 nt, Artificial Sequence; identical to SEQ ID NO: 4466
  derived and/or modified CDS sequence (AUadapt) from InfluenzaA__ADK33621__HA

SEQ ID NO: 5506 - RNA, 1701 nt, Artificial Sequence
  derived and/or modified CDS sequence (AUadapt) from InfluenzaA__ADK33631__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggucaagcacaacgggaagcucugcaagcugcgcggcguggcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucaacuacgaggagcuccgggagcagcugagcuccgucucguccuucgagcgcuucgagaucuuccccaagaccagcuccuggcccaaccacgacucgaacaagggggugaccgccgccugcccgcacgccggcgcgaaguccuucuacaagaaccugaucuggcucgugaagaaggggaacagcuaccccaagcuguccaagucguacaucaacgacaagggcaaggagguccuggugcucugggggauccaccaccccagcaccuccgccgaccagcagucgcuguaccagaacgccgacgccuacguguucgucggcacgucccgguacagcaagaaguucaagcccgagaucgccauccgcccgaaggugcgggaccaggagggccgcaugaacuacuacuggacccugguggagcccggggacaagaucaccuucgaggcgaccggcaaccucgucgugccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggucaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacucgaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagucgacccgcaucuaccagauccuggcgaucuacuccaccguggccagcucgcuggugcucgucgugucccugggggccaucagcuucuggaugugcuccaacggcagccugcagugccggaucugcaucuga

SEQ ID NO: 5507 - RNA, 1701 nt, Artificial Sequence; identical to SEQ ID NO: 4466
  derived and/or modified CDS sequence (AUadapt) from InfluenzaA__ADK33641__HA

SEQ ID NO: 5508 - RNA, 1701 nt, Artificial Sequence; identical to SEQ ID NO: 4078
  derived and/or modified CDS sequence (AUadapt) from InfluenzaA__ADK33651__HA

SEQ ID NO: 5509 - RNA, 1701 nt, Artificial Sequence; identical to SEQ ID NO: 4078
  derived and/or modified CDS sequence (AUadapt) from InfluenzaA__ADK33661__HA

SEQ ID NO: 5510 - RNA, 1701 nt, Artificial Sequence; identical to SEQ ID NO: 4078
  derived and/or modified CDS sequence (AUadapt) from InfluenzaA__ADK33671__HA

SEQ ID NO: 5511 - RNA, 1701 nt, Artificial Sequence
  derived and/or modified CDS sequence (AUadapt) from InfluenzaA__ADK33681__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaagcucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 5512 - RNA, 1701 nt, Artificial Sequence; identical to SEQ ID NO: 4527
  derived and/or modified CDS sequence (AUadapt) from InfluenzaA__ADK33691__HA

SEQ ID NO: 5513 - RNA, 1701 nt, Artificial Sequence
  derived and/or modified CDS sequence (AUadapt) from InfluenzaA__ADK33701__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcgucuaccagauccuggcgaucuacuccaccguggccucgagccuggugcucgucgugucccugggggccaucucguucuggaugugcuccaacggcagccugcagugccggaucugcaucuga

SEQ ID NO: 5514 - RNA, 1701 nt, Artificial Sequence
  derived and/or modified CDS sequence (AUadapt) from InfluenzaA__ADK33711__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggagauccuggugcucugggggauccaccaccccucgaccuccgccgaccagcagagccuguaccagaacgccgacgccuacgucuucgugggcacgucccgguacucgaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacaucccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgugaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgucaagcucgagagcacccgcaucuaccagauccuggcgaucuacuccaccguggccucgagccuggugcucgucgugucccugggggccaucucguucuggaugugcuccaacggcagccugcagugccggaucugcaucuga

SEQ ID NO: 5515 - RNA, 1701 nt, Artificial Sequence
  derived and/or modified CDS sequence (AUadapt) from InfluenzaA__ADK33721__HA
augaaggccauccuggugguccuccuguacaccuucgugaccgccaacgcggacacgcugugcaucggcuaccacgccaacaacucgaccgacaccguggacaccguccucgagaagaacgugacggugacccacuccgucaaccugcuggaggacaagcacaacgggaagcucugcaagcugcgcggcguggcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgucucguccuucgagcgcuucgagaucuuccccaagaccagcuccuggcccaaccacgacucgaacaagggggugaccgccgccugcccgcacgccggcgccaaguccuucuacaagaaccugaucuggcucgugaagaaggggaacagcuaccccaagcuguccaagucguacaucaacgacaagggcaaggagguccuggugcucugggggauccaccaccccagcaccuccgcggaccagcagucgcuguaccagaacgccgacgccuacguguucgucggcacgucccgguacagcaagaaguucaagcccgagaucgccauccgcccgaaggugcgggaccaggagggccgcaugaacuacuacuggacccugguggagcccggggacaagaucaccuucgaggccaccggcaaccucgucgugccccgguacgcguucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgccaccggccugcgcaacgugccguccauccagucgcgggggcuguucggcgcgaucgccggguucaucgagggcggcuggacggggaugguggacggcugguacggguaccaccaccagaacgagcagggcuccggguacgccgccgaccucaagagcacccagcacgccaucgacgagaucaccaacaaggucaacuccgugaucgagaagaugaacacccaguucacggcggucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacucgaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagucgacccgcaucuaccagauccuggccaucuacuccaccguggcgagcucgcuggugcucgucgugucccugggggccaucagcuucuggaugugcuccaacggcagccugcagugccggaucugcaucuga

SEQ ID NO: 5516 - RNA, 1701 nt, Artificial Sequence
  derived and/or modified CDS sequence (AUadapt) from InfluenzaA__ADK33731__HA
augaaggccacccuggugguccuccuguacaccuucgccacggcgaacgccgacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagacguccagcuccggcaacgggaccugcuaccccggcgacuucaucgacuacgaggagcuccgggagcagcugucguccgugucguccuucgagcgcuucgagaucuuccccaagaccagcuccuggcccaaccacgacucgaacaagggcgucaccgccgccugcccgcacgccggggcgaaguccuucuacaagaaccugaucuggcucgugaagaagggcaacagcuaccccaagcuguccaagucguacaucaacgacaaggggaaggaggugcugguccucuggggcauccaccaccccucgacguccgccgaccagcagagccuguaccagaacgccgacgccuacgccuucgugggcaccucccgguacucgaagaaguucaagcccgagaucgcgauccgcccgaaggugcgggaccaggaggggcgcaugaacuacuacuggacccuggucgagcccggcgacaagaucaccuucgaggccacggggaaccuccuggugccccgguacgccuucgccauggagcgcaacgccggcuccggcaucaucaucagcgacacccccgugcacgacugcaacacgaccugccagaccccgaagggggcgaucaacaccucccugcccuuccagaacauccaccccaucaccaucggcaagugccccaaguacgucaagucgaccaagcuccggcuggccacggggcugcgcaacgugccguccauccagucgcggggccucuucggggccaucgccggcuucaucgagggcggguggaccggcaugguggacgggugguacggcuaccaccaccagaacgagcagggguccggcuacgccgcggaccucaagagcacccagaacgccaucgacgagaucaccaacaaggucaacuccgugaucgagaagaugaacacgcaguucaccgccgugggcaaggaguucaaccaccuggagaagcgcaucgagaaccugaacaagaaggucgacgacggguuccuggacaucuggaccuacaacgccgagcugcucgugcugcuggagaacgagcggacccucgacuaccacgacucgaacgucaagaaccuguacgagaaggugcgcucccagcugaagaacaacgccaaggagaucggcaacgggugcuucgaguucuaccacaagugcgacaacacgugcauggagagcgugaagaacggcaccuacgacuaccccaaguacuccgaggaggcgaagcucaaccgggaggagaucgacggggucaagcuggagucgacccgcaucuaccagauccuggccaucuacuccaccguggccucgagccucgugcuggucgugucccugggcgccaucucguucuggaugugcuccaacggcagccuccagugccggaucugcaucuga

SEQ ID NO: 5517 - RNA, 1701 nt, Artificial Sequence; identical to SEQ ID NO: 5081
  derived and/or modified CDS sequence (AUadapt) from InfluenzaA__ADK33741__HA

SEQ ID NO: 5518 - RNA, 1701 nt, Artificial Sequence; identical to SEQ ID NO: 116
  derived and/or modified CDS sequence (AUadapt) from InfluenzaA__ADK33751__HA

SEQ ID NO: 5519 - RNA, 1701 nt, Artificial Sequence
  derived and/or modified CDS sequence (AUadapt) from InfluenzaA__ADK33761__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugucccucgcgaccggccugcggaacgugccgucgauccagucccgcgggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacucggucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgcgaggagaucgacggcgugaagcucgaguccacccggaucuaccagauccuggcgaucuacagcaccgucgccucgucccuggugcucguggucagccugggggccaucuccuucuggaugugcagcaacggcucccugcagugccgcaucugcaucuga

SEQ ID NO: 5520 - RNA, 1701 nt, Artificial Sequence; identical to SEQ ID NO: 4078
  derived and/or modified CDS sequence (AUadapt) from InfluenzaA__ADK33771__HA

SEQ ID NO: 5521 - RNA, 1701 nt, Artificial Sequence; identical to SEQ ID NO: 4078
  derived and/or modified CDS sequence (AUadapt) from InfluenzaA__ADK33781__HA

SEQ ID NO: 5522 - RNA, 1701 nt, Artificial Sequence; identical to SEQ ID NO: 4015
  derived and/or modified CDS sequence (AUadapt) from InfluenzaA__ADK33791__HA

SEQ ID NO: 5523 - RNA, 1701 nt, Artificial Sequence; identical to SEQ ID NO: 5513
  derived and/or modified CDS sequence (AUadapt) from InfluenzaA__ADK33801__HA

SEQ ID NO: 5524 - RNA, 1701 nt, Artificial Sequence
  derived and/or modified CDS sequence (AUadapt) from InfluenzaA__ADK33811__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagcacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcaucaagcucgagagcacccgcaucuaccagauccuggcgaucuacuccaccguggccucgagccugguccucguggugucccugggggccaucucguucuggaugugcuccaacggcagccugcagugccggaucugcaucuga

SEQ ID NO: 5525 - RNA, 1701 nt, Artificial Sequence
  derived and/or modified CDS sequence (AUadapt) from InfluenzaA__ADK33821__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucacgauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggccaucuacucgaccgucgcguccagccuggugcucgccgugucgcugggggccaucuccuucuggaugugcagcaacggcucccugcagugccggaucugcaucuga

SEQ ID NO: 5526 - RNA, 1701 nt, Artificial Sequence
  derived and/or modified CDS sequence (AUadapt) from InfluenzaA__ADK33831__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcaucgcgccccugcaccucgggaagugcaacaucgccggcuggauccuggggaacccggagugcgagucgcuguccaccgccagcuccuggucguacaucgucgagaccuccagcuccgacaacggcacgugcuaccccggcgacuucaucgacuacgaggagcuccgggagcagcugucguccgugagcuccuucgagcgcuucgagaucuuccccaacaccucguccuggcccaaccacgacagcaacaagggggugaccgccgccugcccgcacgccggcgcgaaguccuucuacaagaaccugaucuggcucgucaagaaggggaacucguaccccaagcuguccaagagcuacaucaacgacaagggcaaggaggugcuggugcucugggggauccaccaccccucgaccuccgccgaccagcagagccuguaccagaacgccgacgccuacgucuucgugggcacgucccgguacucgaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgagccugguccucguggugucccugggggccaucucguucuggaugugcuccaacggcagccugcagugccggaucugcaucuga

SEQ ID NO: 5527 - RNA, 1701 nt, Artificial Sequence; identical to SEQ ID NO: 4334
  derived and/or modified CDS sequence (AUadapt) from InfluenzaA__ADK33841__HA

SEQ ID NO: 5528 - RNA, 1701 nt, Artificial Sequence; identical to SEQ ID NO: 5081
  derived and/or modified CDS sequence (AUadapt) from InfluenzaA__ADK33851__HA

SEQ ID NO: 5529 - RNA, 1701 nt, Artificial Sequence; identical to SEQ ID NO: 116
  derived and/or modified CDS sequence (AUadapt) from InfluenzaA__ADK33861__HA

SEQ ID NO: 5530 - RNA, 1701 nt, Artificial Sequence
  derived and/or modified CDS sequence (AUadapt) from InfluenzaA__ADK33871__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggagcaggagggccgcaugaacuacuacuggacccugguggagcccggggacaagaucaccuucgaggcgaccggcaaccucgugaucccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgagccugguccuccuggugucccugggggccaucucguucuggaugugcuccaacggcagccuccagugccggaucugcaucuga

SEQ ID NO: 5531 - RNA, 1701 nt, Artificial Sequence
  derived and/or modified CDS sequence (AUadapt) from InfluenzaA__ADK33881__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccagcuccgacaacggcacgugcuaccccggcgacuucaucgacuacgaggagcugcgggagcagcucucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcuggugaagaaggggaacucguaccccaagcucuccaagagcuacaucaacgacaagggcaaggaggugcugguccugugggggauccaccaccccucgaccuccgccgaccagcagagccucuaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucgccauggagcgcaacgccggguccggcaucaucaucagcgacacgcccgugcacgacugcaacacgaccugccagaccccgaagggcgccaucaacaccucccuccccuuccagaacauccaccccaucaccaucgggaagugccccaaguacgucaagucgaccaagcugcggcuggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcuggagagcaccaagaucuaccagauccucgcgaucuacuccaccgucgccucgagccuggugcugguggucucccucggggccaucucguucuggaugugcuccaacggcagccugcagugccgcaucugcaucuga

SEQ ID NO: 5532 - RNA, 1701 nt, Artificial Sequence
  derived and/or modified CDS sequence (AUadapt) from InfluenzaA__ADK33891__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcaucgcgccccugcaccucgggaagugcaacaucgccggcuggauccuggggaacccggagugcgagucgcuguccaccgccagcuccuggucguacaucgucgagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggugaccgccgccugcccgcacgccggcgcgaaguccuucuacaagaaccugaucuggcucgucaagaaggggaacucguaccccaagcuguccaagagcuacaucaacgacaagggcaaggaggugcuggugcucugggggauccaccaccccucgaccuccgccgaccagcagucgcuguaccagaacgccgacgccuacgucuucgugggcacgucccgguacagcaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucucggacacgcccguccacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacucgaacgugaagaaccucuacgagaaggugcgcaaccagcugaagaacaacgccaaggagaucgggaacggcugcuucgaguucuaccacaagugcgacaacacgugcauggaguccgucaagaacgggaccuacgacuaccccaaguacagcgaggaggccaagcugaaccgggaggagaucgacggcgugaagcucgaguccacccgcaucuaccagauccuggcgaucuacucgaccguggccuccagccugguccucguggugucgcugggggccaucuccuucuggaugugcagcaacggcucccugcagugccggaucugcaucuga

SEQ ID NO: 5533 - RNA, 1701 nt, Artificial Sequence; identical to SEQ ID NO: 5081
  derived and/or modified CDS sequence (AUadapt) from InfluenzaA__ADK33901__HA

SEQ ID NO: 5534 - RNA, 1701 nt, Artificial Sequence
  derived and/or modified CDS sequence (AUadapt) from InfluenzaA__ADK33911__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggggaagcacaacggcaagcucugcaagcugcgcggggucgcgccccugcaccucggcaagugcaacaucgccggguggauccugggcaacccggagugcgagucgcuguccaccgccagcuccuggucguacaucguggagaccuccagcuccgacaacggcacgugcuaccccggggacuucaucgacuacgaggagcuccgggagcagcugucguccgugagcuccuucgagcgcuucgagaucuuccccaagaccucguccuggcccaaccacgacagcaacaagggcgucaccgccgccugcccgcacgccggggcgaaguccuucuacaagaaccugaucuggcucaucaagaagggcaacucguaccccaagcuguccaagagcuacaucaacgacaaggggaaggaggugcuggugcucuggggcauccaccaccccucgaccuccgccgaccagcagagccuguaccagaacgccgacgccuacgucuucgugggcacgucccgguacucgaagaaguucaagcccgagaucgccauccgcccgaaggugcgggaccaggaggggcgcaugaacuacuacuggacccuggucgagcccggcgacaagaucaccuucgaggcgaccgggaaccucguggugccccgguacgccuucgccauggagcgcaacgccggcuccggcaucaucaucagcgacacgcccguccacgacugcaacacgaccugccagaccccgaagggggccaucaacaccucccugcccuuccagaacauccaccccaucaccaucggcaagugccccaaguacgucaagucgaccaagcugcggcucgcgaccgggcugcgcaacaucccguccauccagagccggggccuguucggggccaucgccggcuucaucgagggcggguggacgggcaugguggacgggugguacggcuaccaccaccagaacgagcagggguccggcuacgccgccgaccucaagucgacccagaacgcgaucgacgagaucaccaacaaggugaacuccgugaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggucaagcucgagagcacccgcaucuaccagauccuggcgaucuacuccaccguggccucgagccuggugcucgucgugucccugggcgccaucucguucuggaugugcuccaacggcagccugcagugccggaucugcaucuga

SEQ ID NO: 5535 - RNA, 1701 nt, Artificial Sequence
  derived and/or modified CDS sequence (AUadapt) from InfluenzaA__ADK33931__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcuccuggugucccugggggccaucucguucuggaugugcuccaacggcagccuccagugccggaucugcaucuga

SEQ ID NO: 5536 - RNA, 1701 nt, Artificial Sequence
  derived and/or modified CDS sequence (AUadapt) from InfluenzaA__ADK33941__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucgugaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacaucccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 5537 - RNA, 1701 nt, Artificial Sequence; identical to SEQ ID NO: 5534
  derived and/or modified CDS sequence (AUadapt) from InfluenzaA__ADK33951__HA

SEQ ID NO: 5538 - RNA, 1701 nt, Artificial Sequence; identical to SEQ ID NO: 4078
  derived and/or modified CDS sequence (AUadapt) from InfluenzaA__ADK33961__HA

SEQ ID NO: 5539 - RNA, 1701 nt, Artificial Sequence; identical to SEQ ID NO: 3858
  derived and/or modified CDS sequence (AUadapt) from InfluenzaA__ADK45312__HA

SEQ ID NO: 5540 - RNA, 1701 nt, Artificial Sequence
  derived and/or modified CDS sequence (AUadapt) from InfluenzaA__ADK45410__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacucguucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccagcgggcggaucaccguguccacgaagcgcucgcagcagaccgugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccagcaucaugcgguccgacgcccccaucggcaagugcaacucggagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggcggggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgcgagaacgccgaggacauggggaacggcugcuucaagaucuaccacaagugcgacaacacgugcaucggguccauccgcaacggcaccuacgaccacgacgucuaccgggacgaggcgcucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 5541 - RNA, 1701 nt, Artificial Sequence
  derived and/or modified CDS sequence (AUadapt) from InfluenzaA__ADK45421__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaagaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcagaccgugaucccgaacaucggcagccggccccgcauccggaacauccccucccgcaucucgaucuacuggaccaucgucaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacgcccaacggcuccauccccaacgacaagccguuccagaacgugaaccgcaucaccuacggggccugcccccgguacgugaagcagucgacccugaagcucgcgaccggcaugcgcaacguccccgagaagcagacgcgggggaucuucggcgccaucgccggguucaucgagaacggcugggagggcaugguggacgggugguacggcuuccgccaccagaacuccgaggggcggggccaggccgccgaccugaaguccacccaggcggccaucgaccagaucaacgggaagcugaaccgccucaucggcaagaccaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgcgugcaucgggucgauccgcaacggcaccuacgaccacgacguguaccgggacgaggcccucaacaaccgcuuccagaucaagggggucgagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 5542 - RNA, 1701 nt, Artificial Sequence
  derived and/or modified CDS sequence (AUadapt) from InfluenzaA__ADK45432__HA
augaagaccaucaucgcccugucguacacccucugccugguguucgcccagaagcugccccgcaacgacaacuccacggcgacccucugccugggccaccacgccgucccgaacgggaccaucgugaagaccaucacgaacgaccagaucgaggugaccaacgccaccgagcugguccagucguccagcaccggcgagaucugcgacaacccccaccagauccucgacggggagaacugcacgcugaucgacgcccugcucggcgacccccagugcgacggguuccagaacaagaagugggaccuguucguggagcgguccaaggccuacucgaacugcuaccccuacgacgugccggacuacgcgucccugcgcucgcucgucgccuccagcggcacccuggaguucaacaacgaguccuucaacuggaccggcgugacccagaacgggacgucguccgccugcauccggcgcucgaacaacuccuucuucagccggcugaacuggcucacccaccugaaguucaaguaccccgcccugaacgugaccaugcccaacaacgagcaguucgacaagcucuacaucuggggcguccaccaccccgggaccgacaacgaccagaucuuccuguacgcgcaggccuccggccgcaucacggugucgaccaagcggucccagcagaccgugaucccgaacaucgggucgcgcccccggguccgcaacauccccagccggaucuccaucuacuggaccaucgugaagcccggcgacauccugcucaucaacucgacgggcaaccugaucgccccgcgcggguacuucaagauccgguccggcaagucguccaucaugcgcagcgacgcccccaucgggaagugcaacuccgagugcaucacccccaacggcucgauccccaacgacaagccguuccagaacgugaaccggaucaccuacggcgccugcccccgcuacgucaagcagaacacccugaagcucgcgacggggaugcggaacgugcccgagaagcagacccgcggcaucuucggggccaucgccggcuucaucgagaacgggugggagggcaugguggacggcugguacggguuccggcaccagaacuccgagggccgcgggcaggccgccgaccucaagucgacccaggcggccaucgaccagaucaacggcaagcugaaccggcugaucgggaagaccaacgagaaguuccaccagaucgagaaggaguucuccgaggucgagggccgcauccaggaccuggagaaguacguggaggacacgaagaucgaccuguggagcuacaacgccgagcuccugguggcccuggagaaccagcacaccaucgaccucaccgacuccgagaugaacaagcuguucgagaagaccaagaagcagcugcgcgagaacgccgaggacaugggcaacgggugcuucaagaucuaccacaagugcgacaacgcgugcaucggcucgauccggaacgggacguacgaccacgacgucuaccgcgacgaggcccucaacaaccgguuccagaucaagggcguggagcugaaguccggguacaaggacuggauccuguggaucagcuucgccaucuccugcuuccuccugugcguggcccugcucggcuucaucaugugggccugccagaagggcaacauccgcugcaacaucugcaucuga

SEQ ID NO: 5543 - RNA, 1701 nt, Artificial Sequence; identical to SEQ ID NO: 2679
  derived and/or modified CDS sequence (AUadapt) from InfluenzaA__ADK45443__HA

SEQ ID NO: 5544 - RNA, 1701 nt, Artificial Sequence; identical to SEQ ID NO: 5078
  derived and/or modified CDS sequence (AUadapt) from InfluenzaA__ADK48798__HA

SEQ ID NO: 5545 - RNA, 1701 nt, Artificial Sequence; identical to SEQ ID NO: 4078
  derived and/or modified CDS sequence (AUadapt) from InfluenzaA__ADK62683__HA

SEQ ID NO: 5546 - RNA, 1701 nt, Artificial Sequence
  derived and/or modified CDS sequence (AUadapt) from InfluenzaA__ADK62693__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcggcucgcuguccaccgccagcuccuggucguacaucguggagaccuccagcuccgacaacggcacgugcuaccccggggacuucaucgacuacgaggagcuccgggagcagcugucguccgugagcuccuucgagcgcuucgagaucuuccccaagaccucguccuggcccaaccacgacagcaacaagggcgucaccgccgccugcccgcacgccggggcgaaguccuucuacaagaaccugaucuggcucgugaagaagggcaacucguaccccaagcuguccaagagcuacaucaacgacaaggggaaggaggugcugguccucuggggcauccaccaccccucgaccuccgccgaccagcagagccuguaccagaacgccgacgccuacguguucgugggcacgucccgguacucgaagaaguucaagcccgagaucgccauccgcccgaagguccgggagcaggaggggcgcaugaacuacuacuggacccugguggagcccggcgacaagaucaccuucgaggcgaccgggaaccucguggucccccgguacgccuucgccauggagcgcaacgccggcuccggcaucaucaucagcgacacgcccgugcacgacugcaacacgaccugccagaccccgaagggggccaucaacaccucccugcccuuccagaacgugcaccccaucaccaucggcaagugccccaaguacgucaagucgaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagucgacccagaacgcgaucgacgagaucaccaacaaggucaacuccgugaucgagaagaugaacacccaguucacggccgucggcaaggaguucaaccaccuggagaagcgcaucgagaaccugaacaagaagguggacgacggguuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggucaagcucgagagcacccgcaucuaccagauccuggcgaucuacuccaccguggccucgagccuggugcucgucgugucccugggcgccaucucguucuggaugugcuccaacggcagccugcagugccggaucugcaucuga

SEQ ID NO: 5547 - RNA, 1701 nt, Artificial Sequence; identical to SEQ ID NO: 4015
  derived and/or modified CDS sequence (AUadapt) from InfluenzaA__ADK62703__HA

SEQ ID NO: 5548 - RNA, 1701 nt, Artificial Sequence
  derived and/or modified CDS sequence (AUadapt) from InfluenzaA__ADK64992__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcaucaagcucgagagcacccgcaucuaccagauccuggcgaucuacuccaccguggccucgagccugguccucguggugucccugggggccaucucguucuggaugugcuccaacggcagccugcaguaccggaucugcaucuga

SEQ ID NO: 5549 - RNA, 1701 nt, Artificial Sequence
  derived and/or modified CDS sequence (AUadapt) from InfluenzaA__ADK65001__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugggcggggucgcgccccugcaccucggcaagugcaacaucgccggguggauccugggcaacccggagugcgagucgcuguccaccgccagcuccuggucguacaucguggagaccuccagcuccgacaacggcacgugcuaccccggggacuucaucgacuacgaggagcuccgcgagcagcugucguccgugagcuccuucgagcgguucgagaucuuccccaagaccucguccuggcccaaccacgacagcaacaagggcgucaccgccgccugcccgcacgccggggcgaaguccuucuacaagaaccugaucuggcucgugaagaagggcaacucguaccccaagcuguccaagagcuacaucaacgacaaggggaaggaggugcugguccucuggggcauccaccaccccucgaccuccgccgaccagcagagccuguaccagaacgccgacgccuacguguucgugggcacgucccgcuacucgaagaaguucaagcccgagaucgccauccggccgaagguccgcgaccaggaggggcggaugaacuacuacuggacccugguggagcccggcgacaagaucaccuucgaggcgaccgggaaccucguggucccccgcuacgccuucgccauggagcggaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagucgaccaagcugcgccucgcgaccgggcugcggaacgugccguccauccagagccgcggccuguucggggccaucgccggcuucaucgagggcggguggacgggcaugguggacgggugguacggcuaccaccaccagaacgagcagggguccggcuacgccgccgaccucaagucgacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggguuccucgacaucuggaccuacaacgccgagcugcuggugcuccuggagaacgagcgcacccuggacuaccacgacagcaacgugaagaaccucuacgagaagguccggucccagcugaagaacaacgccaaggagaucggcaacgggugcuucgaguucuaccacaagugcgacaacacgugccuggagucggugaagaacggcaccuacgacuaccccaaguacuccgaggaggccaagcucaaccgcgaggagaucgacggggugaagcuggagagcacccggaucuaccagauccuggcgaucuacuccaccgucgccucgagccucgugcugguggucucccugggcgccaucucguucuggaugugcuccaacggcagccuccagugccgcaucugcaucuga

SEQ ID NO: 5550 - RNA, 1701 nt, Artificial Sequence
  derived and/or modified CDS sequence (AUadapt) from InfluenzaA__ADK65009__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacccgaacaagggggucaccgccgccugcccccacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacguguucgugggcacgucgcgguacuccaagaaguucaagccggagaucgccauccgccccaagguccgggaccaggagggccgcaugaacuacuacuggacccugguggagcccggggacaagaucaccuucggcgcgaccgggaaccucguggucccccgguacgccuucgccauggagcgcaacgccggcagcggcaucaucaucuccgacacgccggugcacgacugcaacacgaccugccagacccccaagggggccaucaacaccucgcugcccuuccagaacauccaccccaucaccaucggcaagugcccgaaguacgugaaguccaccaagcugcggcucgcgaccgggcugcgcaacguccccagcauccagucccggggccuguucggggccaucgccggcuucaucgagggcggguggacgggcaugguggacgggugguacggcuaccaccaccagaacgagcaggggucgggcuacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcaucuaccagauccuggcgaucuacucgaccgucgccuccagccuggugcucguggucucgcugggcgccaucuccuucuggaugugcagcaacggcucccugcagugccggaucugcaucuga

SEQ ID NO: 5551 - RNA, 1701 nt, Artificial Sequence
  derived and/or modified CDS sequence (AUadapt) from InfluenzaA__ADK87287__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaagaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccucggggcggaucaccguguccacgaagcgcagccagcagaccgccaucccgaacaucggcucgcggccccgcgugcggaacauccccucccgcaucagcaucuacuggaccaucgucaagcccggcgacauccugcucaucaacuccaccgggaaccugaucgccccgcggggcuacuucaagauccgcucggggaaguccucgaucaugcgguccgacgcccugaucggcaagugcaacagcgagugcaucacgcccaacggcuccauccccaacgacaagcccuuccagaacgugaaccgcaucaccuacggggcgugcccgcgguacgugaagcagaacacccucaagcuggccaccggcaugcgcaacguccccgagaagcagacgcgggggaucuucggcgccaucgccggguucaucgagaacggcugggagggcaugguggacgggugguacggcuuccgccaccagaacucggaggggcggggccaggccgcggaccugaaguccacccaggccgccaucgaccagaucaacgggaagcucaaccgccugaucggcaagaccaacgagaaguuccaccagaucgagaaggaguucagcgagguggagggccggauccaggaccuggagaaguacgucgaggacaccaagaucgaccucugguccuacaacgccgagcugcugguggcccucgagaaccagcacacgaucgaccugaccgacucggagaugaacaagcuguucgagaagaccaagaagcagcuccgcgagaacgcggaggacauggggaacggcugcuucaagaucuaccacaagugcgacaacgccugcaucggguccauccgcaacggcaccuacgaccacgacguguaccgggacgaggcccugaacaaccgcuuccagaucaagggggucgagcugaaguccggcuacaaggacuggauccucuggaucuccuucgccaucagcugcuuccugcugugcguggcccuccugggcuucaucaugugggcgugccagaaggggaacauccggugcaacaucugcaucuga

SEQ ID NO: 5552 - RNA, 1701 nt, Artificial Sequence
  derived and/or modified CDS sequence (AUadapt) from InfluenzaA__ADK87288__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcaagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagucguucaacuggaccggggugacccagaacggcaccuccagcgccugcauccgccgguccaagaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccaccgggcggaucacggugucgaccaagcgcucccagcagaccgccaucccgaacaucggcagccggccccgcgugcggaacauccccucgcgcaucuccaucuacuggaccaucgucaagcccggcgacauccugcucaucaacucgacggggaaccugaucgccccgcggggcuacuucaagauccgcuccgggaaguccuccaucaugcggagcgacgcccccaucggcaagugcaacuccgagugcaucacccccaacggcucgauccccaacgacaagccguuccagaacgugaaccgcaucaccuacggggcgugcccccgguacgugaagcagaacacccugaagcucgccacgggcaugcgcaacguccccgagaagcagacccgggggaucuucggcgccaucgccggguucaucgagaacggcugggagggcaugguggacgggugguacggcuuccgccaccagaacuccgaggggcggggccaggccgcggaccucaagucgacccaggccgccaucgaccagaucaacgggaagcugaaccgccugaucggcaagaccaacgagaaguuccaccagaucgagaaggaguucuccgagguggagggccggauccaggaccuggagaaguacgucgaggacacgaagaucgaccuguggagcuacaacgccgagcuccugguggcccuggagaaccagcacaccaucgaccucaccgacuccgagaugaacaagcuguucgagaagaccaagaagcagcugcgcgagaacgcggaggacauggggaacggcugcuucaagaucuaccacaagugcgacaacgccugcaucgggucgauccgcaacggcacguacgaccacgacguguaccgggacgaggcccucaacaaccgcuuccagaucaagggggucgagcugaaguccggcuacaaggacuggauccuguggaucagcuucgccaucuccugcuuccuccugugcguggcccugcucggcuucaucaugugggcgugccagaaggggaacauccggugcaacaucugcaucuga

SEQ ID NO: 5553 - RNA, 1701 nt, Artificial Sequence
  derived and/or modified CDS sequence (AUadapt) from InfluenzaA__ADK87289__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcaagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcugggguucaacaacgagagcuucaacuggaccggcgugacccagaacgggaccuccucggccugcauccgccgguccaagaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcggccggaucaccguguccacgaagcgcucgcagcagaccgccaucccgaacaucggcucgcggccccgcgugcggaacauccccucccgcaucagcaucuacuggaccaucgucaagcccggggacauccugcucaucaacuccaccggcaaccugaucgccccgcggggguacuucaagauccgcucgggcaaguccagcaucaugcgguccgacgcccccaucggcaagugcaacucggagugcaucacgcccaacggguccauccccaacgacaagccguuccagaacgugaaccgcaucaccuacggcgcgugcccccgguacgugaagcagaacacccugaagcucgccaccgggaugcgcaacguccccgagaagcagacgcggggcaucuucggggccaucgccggcuucaucgagaacggcugggaggggaugguggacggcugguacggguuccgccaccagaacucggagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccugggcaaguacgucgaggacaccaagaucgaccugugguccuacaacgccgagcuccugguggcccuggagaaccagcacacgaucgaccucaccgacucggagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacguguaccgggacgaggcccucaacaaccgcuuccagaucaagggcgucgagcugaaguccggguacaaggacuggauccuguggaucuccuucgccaucagcugcuuccuccugugcguggcccugcucggcuucaucaugugggcgugccagaaggggaacauccggugcaacaucugcaucuga

SEQ ID NO: 5554 - RNA, 1701 nt, Artificial Sequence
  derived and/or modified CDS sequence (AUadapt) from InfluenzaA__ADK87291__HA
augaagaccaucaucgcccugucguacauccagugccucguguucgcccagaagcugcccggcaacgacaacuccaccgcgacgcugugccucgggcaccacgccgucccgaacggcaccaucgugaagaccaucaccaacgaccagaucgaggugacgaacgccaccgagcugguccagucguccucgaccggggagaucugcgacagcccccaccagauccuggacggcaagaacugcacccucaucgacgcccugcugggggacccccagugcgacggcuuccagaacaagaagugggaccucuucguggagcgcucgaaggccuacuccaacugcuaccccuacgacgugccggacuacgcgucgcugcggucccuggucgccagcuccggcacgcucgaguucaacaacgagucguucaacuggaccggggugacccagaacggcaccuccucggccugcauccgccgguccaagaacucguucuucucccgccugaacuggcugacgcaccucaacuucaaguaccccgcccugaacgugaccaugcccaacaacgagcaguucgacaagcuguacaucuggggcguccaccaccccgggaccgacaaggaccagaucagccucuacgcgcaggccuccgggcggaucaccgugucgacgaagcgcucgcagcagaccgccaucccgaacaucggcucccggccccgcgugcggaacauccccagccgcaucuccaucuacuggaccaucgucaagcccggcgacauccugcugaucaacucgaccgggaaccucaucgccccgcggggcuacuucaagauccgcuccgggaaguccuccaucaugcggucggacgcccccaucggcaagugcaacuccgagugcaucacgcccaacggcucgauccccaacgacaagccguuccagaacgugaaccgcaucaccuacggggcgugcccccgguacgugaagcagaacacccugaagcuggccaccggcaugcgcaacguccccgagaagcagacgcgggggaucuucggcgccaucgccggguucaucgagaacggcugggagggcaugguggacgggugguacggcuuccgccaccagaacuccgaggggcggggccaggccgcggaccucaagagcacccaggccgccaucgaccagaucaacgggaagcugaaccgccugaucggcaagaccaacgagaaguuccaccagaucgagaaggaguucuccgagguggagggccggauccaggaccucgggaaguacgucgaggacaccaagaucgaccuguggucguacaacgccgagcugcucguggcccuggagaaccagcacacgaucgaccugaccgacuccgagaugaacaagcuguucgagaagaccaagaagcagcuccgcgagaacgcggaggacaugggcaacgggugcuucaagaucuaccacaagugcgacaacgccugcaucggcucgauccgcaacgggaccuacgaccacgacguguaccgggacgaggcccugaacaaccgcuuccagaucaagggcgucgagcucaaguccggcuacaaggacuggauccuguggaucagcuucgccaucuccugcuuccugcucugcguggcccugcugggguucaucaugugggcgugccagaagggcaacauccggugcaacaucugcaucuga

SEQ ID NO: 5555 - RNA, 1701 nt, Artificial Sequence
  derived and/or modified CDS sequence (AUadapt) from InfluenzaA__ADK87293__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcaagaacugcacccugaucgacgcccugcucggggacccccagugcgacggcuuccagaacaagaagugggaccuguucguggagcgcuccaaggccuacuccaacugcuaccccuacgacgugccggacuacgcgucgcugcggucccucgucgccagcuccggcacgcuggaguucaacaacgagucguucaacuggaccggggugacccaggacggcaccuccagcgccugcauccgccgguccaagaacucguucuucuccaagcugaacuggcucacgcaccugaacuucaaguaccccgcccugaacgugaccaugcccaacaacgagcaguucgacaagcucuacaucuggggcguccaccaccccgggaccgacaaggaccagaccuuccuguacgcgcaggccucggggcgcaucacgguguccaccaagcggagccagcagaccgccaucccgaacaucggcucgcgcccccgggugcgcaacauccccucccggaucucgaucuacuggaccaucgucaagcccggcgacauccugcucaucaacuccacggggaaccugaucgccccgcgcggcuacuucaagauccggagcgggaaguccucgaucaugcgcuccgacgcccccaucggcaagugcaacagcgagugcaucacccccaacggcuccauccccaacgacaagccguuccagaacgugaaccggaucaccuacggggcgugcccccgcuacgugaagcagaacacccugaagcucgccacgggcaugcggaacguccccgagaagcagacccgcgggaucuucggcgccaucgccggguucaucgagaacggcugggagggcaugguggacgggugguacggcuuccggcaccagaacucggaggggcgcggccaggccgcggaccugaaguccacccaggccgccaucgaccagaucaacgggaagcugaaccggcucaucggcaagaccaacgagaaguuccaccagaucgagaaggaguucucggagguggagggccgcauccaggaccuggagaaguacgucgaggacacgaagaucgaccugugguccuacaacgccgagcuccugguggcccuggagaaccagcacaccaucgaccucaccgacagcgagauguccaagcuguucgagaagaccaagaagcagcugcgggagaacgcggaggacauggggaacggcugcuucaagaucuaccacaagugcgacaacgccugcaucgggucgauccgcaacggcacguacgaccacgacguguaccgcgacgaggcccucaacaaccgguuccagaucaagggggucgagcugaaguccggcuacaaggacuggauccuguggaucagcuucgccaucuccugcuuccuccugugcguggcccugcucggcuucaucaugugggcgugccagaaggggaacauccgcugcaacaucugcaucuga

SEQ ID NO: 5556 - RNA, 1701 nt, Artificial Sequence
  derived and/or modified CDS sequence (AUadapt) from InfluenzaA__ADK87295__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcaagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcagccuggaguucaacaacgaguccuucaacuggacgggggugacccagaacggcaccucguccgccugcauccgccggucgaagaacuccuucuucagccgccugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaggccuccgggcggaucaccgugucgaccaagcgcucgcagcagacggccaucccgaacaucggcucccggccccgcgugcggaacauccccagccgcaucuccaucuacuggaccaucgucaagcccggcgacauccugcucaucaacucgaccgggaaccugaucgccccgcggggcuacuucaagauccgcuccgggaaguccuccaucaugcggagcgacgcccccaucggcaagugcaacuccgagugcaucacccccaacggcucgauccccaacgacaagccguuccagaacgugaaccgcaucacguacggggcgugcccccgguacgugaagcagaacacccugaagcucgccaccggcaugcgcaacguccccgagaagcagacccgggggaucuucggcgccaucgccggguucaucgagaacggcugggagggcaugguggacgggugguacggcuuccgccaccagaacuccgaggggcggggccaggccgcggaccucaagucgacgcaggccgccaucgaccagaucaacgggaagcugaaccgccugaucggcaagaccaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacaccaucgaccucacggacuccgagaugaacaagcuguucgagaagaccaagaagcagcugcgcgagaacgcggaggacauggggaacggcugcuucaagaucuaccacaagugcgacaacgccugcaucgggucgauccgcaacggcaccuacgaccacgacguguaccgggacgaggcccucaacaaccgcuuccagaucaagggggucgagcugaaguccggcuacaaggacuggauccuguggaucagcuucgccaucuccugcuuccuccugugcguggcccugcucggcuucaucaugugggcgugccagaaggggaacauccggcgcaacaucugcaucuga

SEQ ID NO: 5557 - RNA, 1701 nt, Artificial Sequence
  derived and/or modified CDS sequence (AUadapt) from InfluenzaA__ADK87296__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacccgaacaagggggucaccgccgccugcccccacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacguguucgugggcacgucgcgguacuccaagaaguucaagccggagaucgccauccgccccaagguccgggaccaggagggccgcaugaacuacuacuggacccugguggagcccggggacaagaucaccuucgaggcgaccggcaaccucguggucccccggugcgccuucgccauggagcgcaacgccgggagcggcaucaucaucuccgacacgccggugcacgacugcaacacgaccugccagacccccaagggcgccaucaacaccucgcugcccuuccagaacauccaccccaucaccaucgggaagugcccgaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcucgggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 5558 - RNA, 1701 nt, Artificial Sequence
  derived and/or modified CDS sequence (AUadapt) from InfluenzaA__ADK87298__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacucgggcacgugcuaccccggcgacuucaucgacuacgaggagcuccgggagcagcuguccucgguguccagcuucgagcgcuucgagaucuuccccaagaccuccucguggcccaaccacgacccgaacaagggggucaccgccgccugcccccacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacucgaagaaguucaagccggagaucgccauccgccccaagguccgggaccaggagggccgcaugaacuacuacuggacccugguggagcccggggacaagaucaccuucgaggcgaccggcaaccucguggucccccgguacgccuucgccauggagcgcaacgccggguccggcaacaucaucagcgacacgccggugcacgacugcaacacgaccugccagacccccaagggcgccaucaacaccucccugcccuuccagaacauccaccccaucaccaucgggaagugcccgaaguacgucaagucgaccaagcugcggcucgcgaccggccugcgcaacgugcccuccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaaccccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 5559 - RNA, 1701 nt, Artificial Sequence
  derived and/or modified CDS sequence (AUadapt) from InfluenzaA__ADK87300__HA
augaagaccaucaucgcccugucguacauccucugcaugguguucgcccagaagcugcccggcaacgacaacuccaccgcgacgcugugccucgggcaccacgccgucccgaacggcaccaucgugaagaccaucaccaacgaccagaucgaggugacgaacgccaccgagcugguccagucguccagcaccggggagaucugcgacucgccccaccagauccuggacggcaagaacugcacccucaucgacgcccugcugggggacccccagugcgacggcuuccagaacaagaagugggaccucuucguggagcgcucgaaggccuacuccaacugcuaccccuacgacgugccggacuacgcgagccugcggucccuggucgccucguccggcacgcucgaguucaacaacgagagcuucaacuggaccggggugacccagaacggcaccuccucggccugcauccgccgguccaagaacucgcuguucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcagaccgccaucccgaacaucggcucgcggccccgcgugcggaacauccccucccgcaucagcaucuacuggaccaucgucaagcccggcgacauccugcucaucaacuccaccgggaaccugaucgccccgcggggcuacuucaagauccgcucggggaaguccagcaucaugcgguccgacgcccccaucggcaagugcaacucggagugcaucgcgcccaacggcuccauccccaacgacaagucguuccagaacgugaaccgcaucacguacggggccugcccgcgguacgugaagcagaacacccugaagcucgccaccggcaugcgcaacguccccgagaagcagacccgggggaucuucggcgccaucgccggguucaucgagaacggcugggagggcaugguggacgggugguacggcuuccgccaccagaacuccgaggggcggggccaggcggccgaccugaaguccacgcaggccgccaucgaccagaucaacgggaagcugaaccgccucaucggcaagaccaacgagaaguuccaccagaucgagaaggaguucuccgagguggagggccggauccaggaccuggagaaguacgucgaggacaccaagaucgaccuguggagcuacaacgccgagcuccugguggcgcuggagaaccagcacaccaucgaccucacggacuccgagaugaacaagcuguucgagaagaccaagaagcagcugcgcgagaacgccgaggacauggggaacggcugcuucaagaucuaccacaagugcgacaacgccugcaucgggucgauccgcaacggcaccuacgaccacgacguguaccgggacgaggcccucaacaaccgcuuccagaucaagggggucgagcugaaguccggcuacaaggacuggauccuguggaucagcuucgccaucuccugcuuccuccugugcguggcgcugcucggcuucaucaugugggccugccagaaggggaacauccggugcaacaucugcaucuga

SEQ ID NO: 5560 - RNA, 1701 nt, Artificial Sequence
  derived and/or modified CDS sequence (AUadapt) from InfluenzaA__ADK87302__HA
augaagaccaucaucgcccugucguacauccucugcaugguguucgcccagaagcugcccggcaacgacaacuccaccgcgacgcugugccucgggcaccacgccgucccgaacggcaccaucgugaagaccaucaccaacgaccagaucgaggugacgaacgccaccgagcugguccagucguccagcaccggggagaucugcgacucgccccaccagauccuggacggcaagaacugcacccucaucgacgcccugcugggggacccccagugcgacggcuuccagaacaagaagugggaccucuucguggagcgcuccaaggccuacuccaacugcuaccccuacgacgugccggacuacgcgucgcugcggucccuggucgccagcuccggcacgcucgaguucaacaacgagucguucaacuggaccggggugacccagaacggcaccuccagcgccugcauccgccgguccaagaacucguucuucucccgccugaacuggcugacgcaccucaacuucaaguaccccgcccugaacgugaccaugcccaacaacgagcaguucgacaagcuguacaucuggggcguccaccaccccgggaccgacaaggaccagaucuuccucuacgcgcaggccucggggcggaucaccguguccacgaagcgcagccagcagaccgccaucccgaacaucggcucgcggccccgcgugcggaacauccccucccgcaucucgaucuacuggaccaucgucaagcccggcgacauccugcugaucaacuccaccgggaaccucaucgccccgcggggcuacuucaagauccgcagcgggaaguccucgaucaugcgguccgacgcccccaucggcaagugcaacagcgagugcaucacgcccaacggcuccauccccaacgacaagccguuccagaacgugaaccgcaucaccuacggggcgugcccccgguacgugaagcagaacacccugaagcuggccaccggcaugcgcaacguccccgagaagcagacgcgggggaucuucggcgccaucgccggguucaucgagaacggcugggagggcaugguggacgggugguacggcuuccgccaccagaacucggaggggcggggccaggccgcggaccucaaguccacccaggccgccaucgaccagaucaacgggaagcugaaccgccugaucggcaagaccaacgagaaguuccaccagaucgagaaggaguucucggagguggagggccggauccaggaccucgagaaguacgucgaggacaccaagaucgaccugugguccuacaacgccgagcugcucguggcccuggagaaccagcacacgaucgaccugaccgacagcgagaugaacaagcuguucgagaagaccaagaagcagcuccgcgagaacgcggaggacauggggaacggcugcuucaagaucuaccacaagugcgacaacgccugcaucggguccauccgcaacggcaccuacgaccacgacguguaccgggacgaggcccugaacaaccgcuuccagaucaagggggucgagcucaagucgggcuacaaggacuggauccuguggaucuccuucgccaucagcugcuuccugcucugcguggcccugcugggcuucaucaugugggcgugccagaaggggaacauccggugcgacaucugcaucuga

SEQ ID NO: 5561 - RNA, 1701 nt, Artificial Sequence
  derived and/or modified CDS sequence (AUadapt) from InfluenzaA__ADK87304__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccagaucgaggugacgaacgccaccgagcugguccagucguccagcaccggggagaucugcgacucgccccaccagauccuggacggcaagaacugcacccucaucgacgcccugcugggggacccccagugcgacggcuuccagaacaagaagugggaccucuucguggagcgcuccaaggccuacuccaacugcuaccccuacgacgugccggacuacgcgagccugcggucccuggucgccucguccggcacgcucgaguucaacaacgagagcuucaacuggaccggggugacccagaacggcaccuccucggccugcauccgccgguccaagaacucguucuucucccgccugaacuggcugacgcaccucaacuucaaguaccccgcccugaacgugaccaugcccaacaacgagcaguucgacaagcuguacaucuggggcguccaccaccccgggaccgacaaggaccagaucuuccucuacgcgcaggccagcgggcggaucaccguguccacgaagcgcucgcagcagaccgccaucccgaacaucggcagccggccccgcgugcggaacauccccucccgcaucucgaucuacuggaccaucgucaagcccggcgacauccugcugaucaacuccaccgggaaccucaucgccccgcggggcuacuucaagauccgcagcgggaaguccucgaucaugcgguccgacgcccccaucggcaagugcaacucgggcugcaucacgcccaacggguccauccccaacgacaagccguuccagaacgugaaccgcaucaccuacggcgcgugcccccgguacgugaagcagaacacccugaagcuggccaccgggaugcgcaacguccccgagaagcagacgcggggcaucuucggggccaucgccggcuucaucgagaacggcugggaggggaugguggacggcugguacggguuccgccaccagaacagcgagggccgggggcaggccgcggaccucaaguccacccaggccgccaucgaccagaucaacggcaagcugaaccgccugaucggcaagaccaacgagaaguuccaccagaucgagaaggaguucucggagguggaggggcggauccaggaccucgagaaguacgucgaggacaccaagaucgaccugugguccuacaacgccgagcugcucguggcccuggagaaccagcacacgaucgaccugaccgacagcgagaugaacaagcuguucgagaagaccaagaagcagcuccgcgagaacgcggaggacaugggcaacgggugcuucaagaucuaccacaagugcgacaacgccugcaucggcuccauccgcaacgggaccuacggccacgacguguaccgggacgaggcccugaacaaccgcuuccagaucaagggcgucgagcucaagucgggguacaaggacugguuccuguggaucuccuucgccaucagcugcuuccugcucugcguggcccugcugggcuucaucaugugggcgugccagaaggggaacauccggugcaacaucugcaucuga

SEQ ID NO: 5562 - RNA, 1701 nt, Artificial Sequence
  derived and/or modified CDS sequence (AUadapt) from InfluenzaA__ADK87306__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccgccgagcugguccagucguccagcaccggggagaucugcgacucgccccaccagauccucgacggcaagaacugcacccugaucgacgcccugcucggggacccccagugcgacggcuuccagaacaagaagugggaccuguucgugggccgcuccaaggcguacuccaacugcuaccccuacgacgugccggacuacgccucgcugcggucccucgucgccagcuccgggacccuggaguucaacaacgagucguucaacuggacgggcgugacccagaacgggaccuccucggccugcauccgccgguccaagaacagcuucuucucccgccugaacuggcucacccaccugaacuucaaguaccccgcgcugaacgugacgaugcccaacaacgagcaguucgacaagcucuacaucuggggcguccaccaccccgggaccgacaaggaccagaucuuccuguacgcccaggccucgggccggaucaccguguccaccaagcgcucgcagcagacggccaucccgaacaucggcagccggccccgcgugcggaacauccccucccgcaucucgaucuacuggaccaucgucaagcccggggacauccugcucaucaacuccaccggcaaccugaucgccccgcggggguacuucaagauccgcucgggcaaguccagcaucaugcgguccgacgcgcccaucggcaagugcaacucggagugcaucacccccaacggguccauccccaacgacaagccguuccagaacgugaaccgcaucacguacggcgccugcccccgguacgugaagcagaacacccugaagcucgccaccgggguccgcaacgugcccgagaagcagacccggggcaucuucggggccaucgccggcuucaucgagaacggcugggaggggaugguggacggcugguacggguuccgccaccagaacucggagggccgggggcaggcggccgaccugaaguccacgcaggccgccauggaccagaucaacggcaagcugaaccgccucaucggcaagaccaacgagaagcugcaccagaccgagaaggaguucagcgaggucgaggggcggauccaggaccuggagaaguacguggaggacaccaagaucgaccucugguccuacaacgccgagcugcugguggcgcucgagucgcagcacacgaucgaccugaccgacuccgagaugaacaagcuguucgagaagaccaagaagcagcuccgcgagaacgccgaggacaugggcaacgggugcuucaagaucuaccacaagugcgacaacgccugcaucggcucgauccgcaacgggaccuacgaccacgacgucuaccgggacgaggcccugaacaaccgcuuccagaucaagggcguggagcugaaguccggcuacaaggacuggauccucuggaucagcuucgccaucuccugcuuccugcugugcguggcgcuccugggguucaucaugugggccugccagaagggcaacauccggugcaacaucugcaucuga

SEQ ID NO: 5563 - RNA, 1701 nt, Artificial Sequence
  derived and/or modified CDS sequence (AUadapt) from InfluenzaA__ADK87308__HA
augaagaccaucaucgcccugucguacauccucugcaugguguucgcccagaagcugcccggcaacgacaacuccaccgcgacgcugugccucgggcaccacgccgucccgaacggcaccaucgugaagaccaucaccaacgaccagaucgaggugacgaacgccaccgagcugguccagucguccagcaccggggagaucugcgacucgccccaccagauccuggacggcaagaacugcacccucaucgacgcccugcugggggacccccagugcgacggcuuccagaacaagaagugggaccucuucguggagcgcuccaaggccuacuccaacugcuaccccuacgacgugccggacuacgcgucgcugcggucccuggucgccagcuccggcacgcucgaguucaacaacgagucguucaacuggaccggggugacccagaacggcaccuccucggccugcauccgccgguccaagaacagcuucuucucccgccugaacuggcugacgcaccucaacuucaaguaccccgcccugaacgugaccaugcccaacaacgagcaguucgacaagcuguacaucuggggcguccaccaccccgggaccgacaaggaccagaucuuccucuacgcgcaggccucggggcggaucaccguguccacgaagcgcucgcagcagaccgccaucccgaacaucggcagccggccccgcgugcggaacauccccucccgcaucucgaucuacuggaccaucgucaagcccggcgacauccugcugaucaacuccaccgggaaccucaucgccccgcggggcuacuucaagauccgcucggggaaguccagcaucaugcgguccgacgcccccaucggcaagugcaacucggagugcaucacgcccaacggcuccauccccaacgacaagccguuccagaacgugaaccgcaucaccuacggggcgugcccccgguacgugaagcagaacacccugaagcuggccaccggcaugcgcaacguccccgagaagcagacgcgggggaucuucggcgccaucgccggguucaucgagaacggcugggagggcaugguggacgggugguacggcuuccgccaccagaacucggaggggcggggccaggccgcggaccucaaguccacccaggccgccaucgaccagaucaacgggaagcugaaccgccugaucggcaagaccaacgagaaguuccaccagaucgagaaggaguucagcgagguggagggccggauccaggaccucgagaaguacgucgaggacaccaagaucgaccugugguccuacaacgccgagcugcucguggcccuggagaaccagcacacgaucgaccugaccgacucggagaugaacaagcuguucgagaagaccaagaagcagcuccgcgagaacgcggaggacauggggaacggcugcuucaagaucuaccacaagugcgacaacgccugcaucggguccauccgcaacggcaccuacgaccacgacguguaccgggacgaggcccugaacaaccgcuuccagaucaagggggucgagcucaagucgggcuacaaggacuggauccuguggaucuccuucgccaucagcugcuuccugcuccggguggcccugcugggcuucaucaugugggcgugccagaaggggaacauccgcugcaacaucugcaucuga

SEQ ID NO: 5564 - RNA, 1701 nt, Artificial Sequence
  derived and/or modified CDS sequence (AUadapt) from InfluenzaA__ADK87309__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcaagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaagaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcagaccgccaucccgaacaucggcucgcggccccgcgugcggaacauccccucccgcaucagcaucuacuggaccaucgucaagcccggcgacauccugcucaucaacuccaccgggaaccugaucgccccgcggggcuacuucaagauccgcucggggaaguccagcaucaugcgguccgacgcccccaucggcaagugcaacucggagugcaucacgcccaacggcuccauccccaacgacaagccguuccagaacgugaaccgcaucaccuacggggcgugcccccgguacgugaagcagaacacccugaagcucgccaccggcaugcgcaacguccccgagaagcagacgcgggggaucuucggcgccaucgccggguucaucgagaacggcugggagggcaugguggacgggugguacggcuuccgccaccagaacucggaggggcggggccaggccgcggaccugaaguccacccaggccgccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacacgaucgaccucaccgacucggagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacguguaccgggacgaggcccucaacaaccgcuuccagaucaagggggucgagcugaaguccggcuacaaggacuggauccuguggaucuccuucgccaucagcugcuuccuccugugcguggcccuguccggcuucaucaugugggcgugccagaaggggaacauccggugcaacaucugcaucuga

SEQ ID NO: 5565 - RNA, 1701 nt, Artificial Sequence
  derived and/or modified CDS sequence (AUadapt) from InfluenzaA__ADK87310__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugucguccuucgagcgcuucgagaucuuccccaagaccgggagcuggcccaaccacgacccgaacaagggcgucaccgccgccugcccccacgccggggcgaaguccuucuacaagaaccugaucuggcucgugaagaagggcaacucguaccccaagcuguccaagagcuacaucaacgacaaggggaaggaggugcugguccucuggggcauccaccaccccuccaccucggccgaccagcagagccuguaccagaacgccgacgccuacguguucgugggcacgucccgguacucgaagaaguucaagccggagaucgccauccgccccaagguccgggaccaggaggggcgcaugaacuacuacuggacccugguggagcccggcgacaagaucaccuucgaggcgaccgggaaccucguggucccccgguacgccuucgccauggagcgcaacgccggcuccggcaucaucaucucggacacgccggugcacgacugcaacacgaccugccagacccccaagggggccaucaacaccucccugcccuuccagaacauccaccccaucaccaucggcaagugcccgaaguacgucaagagcaccaagcugcggcucgcgaccgggcugcgcaacgugcccuccauccagucgcggggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacucgaacgugaagaaccucuacgagaagguccgcucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcucgagagcacccgcaucuaccagauccuggcgaucuacuccaccgucgccucgucccuggugcucguggucagccugggcgccaucucguucuggaugugcuccaacggcagccugcagugccggaucugcaucuga

SEQ ID NO: 5566 - RNA, 1701 nt, Artificial Sequence
  derived and/or modified CDS sequence (AUadapt) from InfluenzaA__ADK87311__HA
augaaggccauccuggugguccuccuguacaccuucgccaccgcgaacgccgacacgcugugcaucggcuaccacgccgacaacucgaccgacaccguggacaccgugcucgagcgcaacgucacggugacccacuccgugaaccugcuggaggacaagcacaacgggaagcucugcaagcugcggggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgcgagcagcugucguccgugagcuccuucgagcgguucgagaucuuccccaagaccucguccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccggccagcagucgcuguaccagaacgccgacgccuacguguucgugggcacgucccgcuacagcaagaaguucaagcccgagaucgccauccggccgaagguccgcgaccaggaggggcggaugaacuacuacuggacccugguggagcccggcgacaagaucaccuucgaggcgaccgggaaccucguggucccccgcuacgccuucgccauggagcggaacgccggcuccggcaucaucaucucggacacgcccgugcacgacugcaacacgaccugccagaccccgaagggggccaucaacaccuccccgcccuuccagaacauccaccccaucaccaucggcaagugccccaaguacgucaagagcaccaagcugcgccuggcgaccgggcuccggaacgugcccuccauccagucgcgcggccuguucggggccaucgccggcuucaucgagggcggguggacgggcaugguggacgggugguacggcuaccaccaccagaacgagcagggguccggcuacgccgccgaccucaagucgacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggguuccuggacaucuggaccuacaacgccgagcuccuggugcugcucgagaacgagcgcacccuggacuaccacgacagcaacgugaagaaccuguacgagaagguccggucccagcucaagaacaacgccaaggagaucggcaacgggugcuucgaguucuaccacaagugcgacaacacgugcauggagucggugaagaacggcaccuacgacuaccccaaguacuccgaggaggccaagcugaaccgcgaggagaucgacggggugaagcuggagagcacccggaucuaccagauccucgcgaucuacuccaccgucgccucgagccuggugcugguggucucccucggcgccaucucguucuggaugugcuccaacggcagccugcagugccgcaucugcaucuga

SEQ ID NO: 5567 - RNA, 1701 nt, Artificial Sequence
  derived and/or modified CDS sequence (AUadapt) from InfluenzaA__ADK87313__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccagaucgaggugacgaacgccaccgagcugguccagucguccagcaccggggagaucugcgacucgccccaccagauccuggacggcaagaacugcacccucaucgacgcccugcugggggacccccagugcgacggcuuccagaacaagaagugggaccucuucguggagcgcuccaaggccuacuccaacugcuaccccuacgacgugccggacuacgcgagccugcggucccuggucgccucguccggcacgcucgaguucaacaacgagagcuucaacuggaccggggugacccagaacggcaccuccucggccugcauccgccgguccaagaacucguucuucucccgccugaacuggcugacgcaccucaacuucaaguaccccgcccugaacgugaccaugcccaacaacgagcaguucgacaagcuguacaucuggggcguccaccaccccgggaccgacaaggaccagaucuuccucuacgcgcaggccagcgggcggaucgccguguccaccaagcgcucgcagcagacggccaucccgaacaucggcagccggccccgcgugcggaacauccccucccgcaucucgaucuacuggaccaucgucaagcccggcgacauccugcugaucaacuccaccgggaaccucaucgccccgcggggcuacuucaagauccgcagcgggaaguccucgaucaugcgguccgacgcgcccaucggcaagugcaacucgggcugcaucacccccaacggguccauccccaacgacaagccguuccagaacgugaaccgcaucacguacggcgccugcccccgguacgugaagcagaacacccugaagcuggccaccgggaugcgcaacguccccgagaagcagacccggggcaucuucggggccaucgccggcuucaucgagaacggcugggaggggaugguggacggcugguacggguuccgccaccagaacagcgagggccgggggcaggcggccgaccucaaguccacgcaggccgccaucgaccagaucaacggcaagcugaaccgccugaucggcaagaccaacgagaaguuccaccagaucgagaaggaguucucggagguggaggggcggauccaggaccucgagaaguacgucgaggacaccaagaucgaccugugguccuacaacgccgagcugcucguggcgcuggagaaccagcacaccaucgaccugacggacagcgagaugaacaagcuguucgagaagaccaagaagcagcuccgcgagaacgccgaggacaugggcaacgggugcuucaagaucuaccacaagugcgacaacgccugcaucggcuccauccgcaacgggaccuacgaccacgacguguaccgggacgaggcccugaacaaccgcuuccagaucaagggcgucgagcucaagucgggcuacaaggacugguuccuguggaucuccuucgccaucagcugcuuccugcucugcguggcgcugcugggguucaucaugugggccugccagaagggcaacauccggugcaacaucugcaucuga

SEQ ID NO: 5568 - RNA, 1701 nt, Artificial Sequence
  derived and/or modified CDS sequence (AUadapt) from InfluenzaA__ADK87315__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugucguccuucgagcgcuucgagaucuuccccaagaccagccccuggccgaaccacgaccccaacaagggggucaccgccgccugcccccacgccggcgcgaaguccuucuacaagaaccugaucuggcucgugaagaaggggaacucguaccccaagcuguccaagagcuacaucaacgacaagggcaaggaggugcugguccucugggggauccaccacccguccaccucggccgaccagcagucgcuguaccagaacgccgacgccuacguguucgugggcacgucccgguacagcaagaaguucaagcccgagaucgccauccgccccaagguccgggaccaggagggccgcaugaacuacuacuggacccugguggagcccggggacaagaucaccuucgaggcgaccggcaaccucguggucccgcgguacgccuucgccauggagcgcaacgccggguccggcaucaucaucucggacacgcccgugcacgacugcaacacgaccugccagacccccaagggcgccaucaacaccucccugcccuuccagaacauccacccgaucaccaucgggaagugccccaaguacgucaagagcaccaagcugcggcucgcgaccggccugcgcaacgugcccuccauccagucgcgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggagagcaaccaccuggagacccgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacuccacgugcauggagagcgugaagaacgggaccuacgacuaccccaaguacuccgaggaggccaagcugaaccgggaggagaucgacggcgugaagcucgagucgacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 5569 - RNA, 1701 nt, Artificial Sequence; identical to SEQ ID NO: 3712
  derived and/or modified CDS sequence (AUadapt) from InfluenzaA__ADK87317__HA

SEQ ID NO: 5570 - RNA, 1701 nt, Artificial Sequence
  derived and/or modified CDS sequence (AUadapt) from InfluenzaA__ADK87319__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacccgaacaagggggucaccgccgccugcccccacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacguguucgugggcacgucgcgguacuccaagaaguucaagccggagaucgccauccgccccaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgccggugcacgacugcaacacgaccugccagacccccaagggcgccaucaacaccucgcugcccuuccagaacauccaccccaucaccaucgggaagugcccgaaguacgugaaguccaccgagcugcggcucgcgaccggccugcgcaacguccccagcauccagucccgggggcuguucggcgccaucgccggguucaucgagggcggcuggacggggaugguggacggcugguacggguaccaccaccagaacgagcagggcucgggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccggauccuggcgaucuacucgaccgucgccuccagccuggugcucguggucucgcugggggccaucuccuucuggaugugcagcaacggcucccugcagugccgcaucugcaucuga

SEQ ID NO: 5571 - RNA, 1701 nt, Artificial Sequence
  derived and/or modified CDS sequence (AUadapt) from InfluenzaA__ADK87321__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccagaucgaggugacgaacgccaccgagcugguccagucguccagcaccggggagaucugcgacucgccccaccagauccuggacggcaagaacugcacccucaucgacgcccugcugggggacccccagugcgacggcuuccagaacaagaagugggaccucuucguggagcgcucgaaggccuacuccaacugcuaccccuacgacgugccggacuacgcgagccugcggucccuggucgccucguccggcacgcucgaguucaacaacgagagcuucaacuggaccggggugacccagaacggcaccuccucggccugcaugcgccgguccaagaacucguucuucucccgccugaacuggcugacgcaccucaacuucaaguaccccgcccugaacgugaccaugcccaacaacgagcaguucgacaagcuguacaucuggggcguccaccaccccgggaccgacaaggaccagaucuuccucuacgcgcaggccagcgggcggaucaccguguccacgaagcgcucgcagcagaccgccaucccgaacaucggcucgcggccccgcgugcggaacauccccucccgcaucagcgucuacuggaccaucgugaagcccggcgacauccugcugaucaacuccaccgggaaccucaucgccccgcggggcuacuucaagauccgcucggggaaguccagcaucaugcgguccgacgccucgaucggcaagugcaacuccggcugcaucacgcccaacgggucgauccccaacgacaagcccuuccagaacgugaaccgcaucaccuacggcgcgugcccgcgguacgucaagcagaacacccugaagcuggccaccgggaugcgcaacgugcccgagaagcagacgcggggcaucuucggggccaucgccggcuucaucgagaacggcugggaggggaugguggacggcugguacggguuccgccaccagaacuccgagggccgggggcaggccgcggaccucaagagcacccaggccgccaucgaccagaucaacggcaagcugaaccgccugaucggcaagaccaacgagaaguuccaccagaucgagaaggaguuccccgaggucgaggggcggauccaggaccucgagaaguacguggaggacaccaagaucgaccugugguccuacaacgccgagccccugguggcccucgagaaccagcacacgaucgaccugaccgacucggagaugaacaagcuguucgagaagaccaagaagcagcuccgcgagaacgcggaggacaugggcaacgggugcuucaagaucuaccacaagugcgacaacgccugcaucggcuccauccgcaacgggaccuacgaccacgacgucuaccgggacgaggcccugaacaaccgcuuccagaucaagggcguggagcugaaguccggcuacaaggacugguuccucuggaucuccuucgccaucagcugcuuccugcugugcguggcccuccugggguucaucaugugggcgugccagaagggcaacauccggugcaacaucugcaucuga

SEQ ID NO: 5572 - RNA, 1701 nt, Artificial Sequence
  derived and/or modified CDS sequence (AUadapt) from InfluenzaA__ADK87323__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcaagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaagaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcagaccgccaucccgaacaucggcucgcggccccgcgugggcaacauccccucccggaucagcaucuacuggaccaucgucaagcccggggacauccugcucaucaacuccaccggcaaccugaucgccccgcgcggguacuucaagauccggucgggcaaguccagcaucaugcgcuccgacgcccccaucggcaagugcaacucggagugcaucacgcccaacggguccauccccaacgacaagccguuccagaacgugaaccggaucaccuacggcgcgugcccccgcuacgugaagcagaacacccugaagcucgccaccgggaugcggaacguccccgagaagcagacgcgcggcaucuucggggccaucgccggcuucaucgagaacggcugggaggggaugguggacggcugguacggguuccggcaccagaacucggagggccgcgggcaggccgcggaccugaaguccacccaggccgccaucgaccagaucaacggcaagcugaaccggcucaucggcaagaccaacgagaaguuccaccagaucgagaaggaguucagcgagguggaggggcgcauccaggaccuggagaaguacgucgaggacaccaagaucgaccugugguccuacaacgccgagcuccugguggcccuggagaaccagcacacgaucgaccucaccgacucggagaugaacaagcuguucgagaagaccaagaagcagcugcgggagaacgcggaggacaugggcaacgggugcuucaagaucuaccacaagugcgacaacgccugcaucggcuccauccgcaacgggaccuacgaccacgacguguaccgcgacgaggcccucaacaaccgguuccagaucaagggcgucgagcugaaguccggcuacaaggacuggauccuguggaucuccuucgccaucagcugcuuccuccugugcguggcccugcucggguucaucaugugggcgugccagaagggcaacauccgcugcaacaucugcaucuga

SEQ ID NO: 5573 - RNA, 1701 nt, Artificial Sequence
  derived and/or modified CDS sequence (AUadapt) from InfluenzaA__ADK87325__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcaagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagucguucaacuggaccggggugacccagaacggcaccuccagcgccugcauccgccgguccaagaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccucggggcggaucaccguguccacgaagcgcagccagcagaccgccaucccgaacaucggcucgcggccccgcgugcggaacauccccucccgcaucucgaucuacuggaccaucgucaagcccggcgacauccugcucaucaacuccaccgggaaccugaucgccccgcggggcuacuucaagauccgcagcgggaaguccucgaucaugcgguccgacgcccccaucggcaagugcaacucggagugcaucacgcccaacggcuccauccccaacgacaagccguuccagaacgugaaccgcaucaccuacggggcgugcccccggcacgugaagcagaacacccugaagcucgccaccggcaugcgcaacguccccgagaagcagacgcgggggaucuucggcgccaucgccggguucaucgagaacggcugggagggcaugguggacgggugguacggcuuccgccaccagaacagcgaggggcggggccaggccgcggaccugaaguccacccaggccgccaucgaccagaucaacgggaagcugaaccgccucaucggcaagaccaacgagaaguuccaccagaucgagaaggaguucucggagguggagggccggauccaggaccuggagaaguacgucgaggacaccaagaucgaccugugguccuacaacgccgagcuccugguggcccuggagaaccagcacacgaucgaccucaccgacucggagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacguguaccgggacgaggcccucaacaaccgcuuccagaucaagggggucgagcugaaguccggcuacaaggacuggauccuguggaucuccuucgccaucagcugcuuccuccugugcguggcccugcucggcuucaucaugugggcgugccagaaggggaacauccggugcaacaucugcaucuga

SEQ ID NO: 5574 - RNA, 1701 nt, Artificial Sequence
  derived and/or modified CDS sequence (AUadapt) from InfluenzaA__ADK87326__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcaagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagucguucaacuggaccggggugacccagaacggcaccuccagcgccugcauccgccgguccaagaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccucggggcggaucaccguguccacgaagcgcagccagcagaccgccaucccgaacaucggcucgcggccccgcgugcggaacauccccucccgcaucucgaucuacuggaccaucgucaagcccggcgacauccugcucaucaacuccaccgggaaccugaucgccccgcggggcuacuucaagauccgcagcgggaaguccucgaucaugcgguccgacgcccccaucggcaagugcaacucggagugcaucacgcccaacggcuccauccccaacgacaagccguuccagaacgugaaccgcaucaccuacggggcgugcccccgguacgugaagcagaacacccugaagcucgccaccggcaugcgcaacguccccgagaagcagacgcgggggaucuucggcgccaucgccggguucaucgagaacggcugggagggcaugguggacgggugguacggcuuccgccaccagaacagcgaggggcggggccaggccgcggaccugaaguccacccaggccgccaucgaccagaucaacgggaagcugaaccgccucaucggcaagaccaacgagaaguuccaccagaucgagaaggaguucucggagguggagggccggauccaggaccuggagaaguacgucgaggacaccaagaucgaccugugguccuacaacgccgagcuccugguggcccuggagaaccagcacacgaucgaccucaccgacucggagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacguguaccgggacgaggcccucaacaaccgcuuccagaucaagggggucgagcugaaguccggcugcaaggacuggauccuguggaucuccuucgccaucagcugcuuccuccugugcguggcccugcucggcuucacgaugugggcgugccagaaggggaacauccggugcaacaucugcaucuga

SEQ ID NO: 5575 - RNA, 1701 nt, Artificial Sequence
  derived and/or modified CDS sequence (AUadapt) from InfluenzaA__ADK87328__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacccgaacaagggggucaccgccgccugcccccacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacguguucgugggcacgagccgguacuccaagaaguucaagccggagaucgccauccgccccaagguccgggaccaggagggccgcaugaacuacuacuggacccugguggagcccggggacaagaucaccuucgaggcgaccggcaaccucguggucccccgguacgccuucgccauggagcgcaacgccgggucgggcaucaucaucuccgacacgccggugcacgacugcaacacgaccugccagacccccaagagcgccaucaacaccucccugcccuuccagaacauccaccccaucaccaucggcaagugcccgaaguacgucaagucgaccaagcugcggcucgcgaccgggcugcgcaacgugcccuccauccagagccggggccuguucggggccaucgccggcuucaucgagggcggguggacgggcaugguggacgggugguacggcuaccaccaccagaacgagcagggguccggcuacgccgccgaccucaagucgacccagaacgcgaucgacgagaucaccaacaaggugaacuccgucaucgagaagaugaacacccaguucacggccguggggaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcucgagagcacccgcaucuaccagauccuggcgaucuacuccaccgucgccucgagccuggugcucguggucucccugggcgccaucucguucuggaugugcuccaacgggagccugcagugccggaucugcaucuga

SEQ ID NO: 5576 - RNA, 1701 nt, Artificial Sequence
  derived and/or modified CDS sequence (AUadapt) from InfluenzaA__ADK87334__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccucggaccagaucgaggugacgaacgccaccgagcugguccaguccagcuccaccggggagaucugcgacucgccccaccagauccucgacggcaagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggucgcucgucgccuccagcggcacgcuggaguucaacaacgaguccuucaacuggaccggggugacccagaacggcaccucguccgccugcauccgccggucgaagaacuccuucuucagcaagcugaacuggcucacgcaccugaacuucaaguaccccgcccugaacgugaccaugcccaacaacgagcaguucgacaagcucuacaucuggggcguccgccaccccgggaccgacaaggaccagaucuuccuguacgcgcaggccuccgggcggaucaccgugucgacgaagcgcagccagcagaccgugaucccgaacaucggcucccggccccgcguccggaacauccccucgcgcaucuccaccuacuggaccaucgugaagcccggcgacauccugcucaucaacagcacggggaaccugaucgccccgcggggcuacuucaagauccgcuccggcaagucguccaucaugcggucggacacccccaucgggaagugcaacuccgagugcaucacccccaacggcagcauccccaacgacaagccguuccagaacgugaaccgcaucaccuacggggccugcccccgguacgucaagcagaacacgcugaagcucgccaccggcaugcgcaacgugcccgagaagcagacccgggggaucuucggcgcgaucgccggguucaucgagaacggcugggagggcaugguggacgggugguacggcuuccgccaccagaacuccgaggggcggggccaggccgccgaccucaagucgacccaggccgcgaucgaccagaucaacgggaagcugaaccgccugaucggcaagacgaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgccugcaucgggucgauccgcaacggcaccuacgaccacgacgucuaccgggacgaggcgcucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 5577 - RNA, 1701 nt, Artificial Sequence
  derived and/or modified CDS sequence (AUadapt) from InfluenzaA__ADK87336__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaagaacagcuucuucuccaagcugaacuggcucacgcaccugaacuucaaguaccccgcccugaacgugaccaugcccaacaacgagcaguucgacaagcucuacaucuggggcguccaccaccccgggaccgaccgcgaccagaucuuccuguacgcgcaggccucggggcggaucaccguguccacgaagcgcagccagcagaccgugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccucgaucaugcgguccgacacgcccaucggcaagagcaacuccgagugcaucacccccaacggcucgauccccaacgacaagccguuccagaacgugaaccgcaucaccuacggggccugcccccgguacgucaagcagaacacccugaagcucgccacgggcaugcgcaacgugcccgagaagcagacccgggggaucuucggcgcgaucgccggguucaucgagaacggcugggagggcaugguggacgggugguacggcuuccgccaccagaacuccgaggggcggggccaggccgccgaccugaaguccacccaggccgcgaucgaccagaucaacgggaagcugaaccgccucaucggcaagaccaacgagaaguuccaccagaucgagaaggaguucuccgaggucgagggccggauccaggaccuggagaaguacguggaggacacgaagaucgaccuguggagcuacaacgccgagcuccugguggcccuggagaaccagcacaccaucgaccucaccgacuccgagaugaacaagcuguucgagaagaccaagaagcagcugcgcgaggacgccgaggacauggggaacggcugcuucaagaucuaccacaagugcgacaacgccugcaucgggucgauccgcaacggcacguacgaccacgacgucuaccgggacgaggcgcucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 5578 - RNA, 1701 nt, Artificial Sequence; identical to SEQ ID NO: 116
  derived and/or modified CDS sequence (AUadapt) from InfluenzaA__ADK87338__HA

SEQ ID NO: 5579 - RNA, 1701 nt, Artificial Sequence
  derived and/or modified CDS sequence (AUadapt) from InfluenzaA__ADK90193__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggugguccuggugcucugggggauccaccaccccagcaccuccgccgaccagcagucgcuguaccagaacgccgacgccuacguguucgucggcacgucccgguacagcaagaaguucaagcccgagaucgccauccgcccgaaggugcgggaccaggagggccgcaugaacuacuacuggacccugguggagcccggggacaagaucaccuucgaggcgaccggcaaccucgucgugccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggucaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacucgaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagucgacccgcaucuaccagauccuggcgaucuacuccaccguggccagcucgcuggugcucgucgugucccugggggccaucagcuucuggaugugcuccaacggcagccugcagugccggaucugcaucuga

SEQ ID NO: 5580 - RNA, 1701 nt, Artificial Sequence
  derived and/or modified CDS sequence (AUadapt) from InfluenzaA__ADK90194__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacguccaaguacucgaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcggaucgagaaccugaacaagaagaucgacgacggcuuccucgacaucuggaccuacaacgccgagcugcugguccuccuggagaacgagcgcacccuggacuaccacgacagcaacgugaagaaccucuacgagaaggugcggucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgcgaggagaucgacggcgugaagcucgagagcacccggaucuaccagauccuggcgaucuacuccaccguggccucgagccugguccucguggugucccugggggccaucucguucuggaugugcuccaacggcagccugcagugccgcaucugcaucuga

SEQ ID NO: 5581 - RNA, 1701 nt, Artificial Sequence
  derived and/or modified CDS sequence (AUadapt) from InfluenzaA__ADK90195__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucgugaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggucaacuccgugaucgagaagaugaacacccaguucacggccgucggcaaggaguucaaccaccuggagaagcgcaucgagaaccugaacaagaagaucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 5582 - RNA, 1701 nt, Artificial Sequence; identical to SEQ ID NO: 62
  derived and/or modified CDS sequence (AUadapt) from InfluenzaA__ADK90196__HA

SEQ ID NO: 5583 - RNA, 1701 nt, Artificial Sequence
  derived and/or modified CDS sequence (AUadapt) from InfluenzaA__ADK90197__HA
augcgcgccauccugggcgugcuccuguacaccuucgccaccgcgaacgccgacacgcugugcaucggguaccacgccaacaacucgaccgacaccgucgacaccgugcucgagaagaacgugacggucacccacuccgugaaccugcuggaggacaagcacaacggcaagcucugcaagcugcgcgggguggcgccccugcaccucggcaagugcaacaucgccggguggauccugggcaacccggagugcgagucgcuguccaccgccagcuccuggucguacaucgucgagaccuccagcuccgacaacggcacgugcuaccccggggacuucaucgacuacgaggagcuccgggagcagcugucguccgugagcuccuucgagcgguucgagaucuuccccaagaccucguccuggcccaaccacgacucgaacaagggcgugaccgccgccugcccgcacgccggggcgaaguccuucuacaagaaccugaucuggcucgucaagaagggcaacagcuaccccaagcuguccaagucguacaucaacgacaaggggaaggaggugcuggugcucuggggcauccaccaccccagcaccuccgccgaccagcagucgcuguaccagaacgccgacgccuacgucuucgugggcacgucccgcuacagcaagaaguucaagcccgagaucgccauccggccgaaggugcgcgaccaggaggggcggaugaacuacuacuggacccuggucgagcccggcgacaagaucaccuucgaggcgaccgggaaccucguggugccccgcuacgccuucgccauggagcggaacgccggcuccggcaucaucaucucggacacgcccguccacgacugcaacacgaccugccagaccccgaagggggccaucaacaccucccugcccuuccagaacauccaccccaucaccaucggcaagugccccaaguacgucaagagcaccaagcugcgccucgcgaccgggcugcggaacgugccguccauccagucgcgcggccuguucggggccaucgccggcuucaucgagggcggguggacgggcaugguggacgggugguacggcuaccaccaccagaacgagcagggguccggcuacgccgccgaccucaagucgacccagaacgcgaucgacgagaucaccaacaaggugaacuccgugaucgagaagaugaacacccaguucacggccgucggcaaggaguucaaccaccuggagaagcggaucgagaaccugaacaagaagguggacgacggguuccucgacaucuggaccuacaacgccgagcugcugguccuccuggagaacgagcgcacccuggacuaccacgacagcaacgugaagaaccucuacgagaaggugcggucccagcugaagaacaacgccaaggagaucggcaacgggugcuucgaguucuaccacaagugcgacaacacgugcauggagucggucaagaacggcaccuacgacuaccccaaguacuccgaggaggccaagcugaaccgcgaggagaucgacggggugaagcucgagagcacccggaucuaccagauccuggcgaucuacuccaccguggccucgagccugguccucguggugucccugggcgccaucucguucuggaugugcuccaacggcagccugcagugccgcaucugcaucuga

SEQ ID NO: 5584 - RNA, 1701 nt, Artificial Sequence
  derived and/or modified CDS sequence (AUadapt) from InfluenzaA__ADK90198__HA
augaaggccauccugggcgugcuccuguacaccuucgccaccgcgaacgccgacacgcugugcaucggguaccacgccaacaacucgaccgacaccgucgacaccgugcucgagaagaacgugacggucacccacuccgugaaccugcuggaggacaagcacaacggcaagcucugcaagcugcgcgggguggcgccccugcaccucggcaagugcaacaucgccggguggauccugggcaacccggagugcgagucgcuguccaccgccagcuccuggucguacaucgucgagaccuccagcuccgacaacggcacgugcuaccccggggacuucaucgacuacgaggagcuccgggagcagcugucguccgugagcuccuucgagcgcuucgagaucuuccccaagaccucguccuggcccaaccacgacucgaacaagggcgugaccgccgccugcccgcacgccggggcgaaguccuucuacaagaaccugaucuggcucgucaagaagggcaacagcuaccccaagcuguccaagucguacaucaacgacaaggggaaggaggugcuggugcucuggggcauccaccaccccagcaccuccgccgaccagcagucgcuguaccagaacgccgacgccuacgucuucgugggcacgucccgguacagcaagaaguucaagcccgagaucgccauccgcccgaaggugcgggaccaggaggggcgcaugaacuacuacuggacccuggucgagcccggcgacaagaucaccuucgaggcgaccgggaaccucguggugccccgguacgccuucgccauggagcgcaacgccggcuccggcaucaucaucucggacacgcccguccacgacugcaacacgaccugccagaccccgaagggggccaucaacaccucccugcccuuccagaacauccaccccaucaccaucggcaagugccccaaguacgucaagagcaccaagcugcggcucgcgaccgggcugcgcaacgugccguccauccagucgcggggccuguucggggccaucgccggcuucaucgagggcggguggacgggcaugguggacgggugguacggcuaccaccaccagaacgagcagggguccggcuacgccgccgaccucaagucgacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggguuccucgacaucuggaccuacaacgccgagcugcugguccuccuggagaacgagcggacccuggacuaccacgacagcaacgugaagaaccucuacgagaaggugcgcucccagcugaagaacaacgccaaggagaucggcaacgggugcuucgaguucuaccacaagugcgacaacacgugcauggagucggucaagaacggcaccuacgacuaccccaaguacuccgaggaggccaagcugaaccgggaggagaucgacggggugaagcucgagagcacccgcaucuaccagauccuggcgaucuacuccaccguggccucgagccugguccucguggugucccugggcgccaucucguucuggaugugcuccaacggcagccugcagugccggaucugcaucuga

SEQ ID NO: 5585 - RNA, 1701 nt, Artificial Sequence; identical to SEQ ID NO: 116
  derived and/or modified CDS sequence (AUadapt) from InfluenzaA__ADK90199__HA

SEQ ID NO: 5586 - RNA, 1701 nt, Artificial Sequence
  derived and/or modified CDS sequence (AUadapt) from InfluenzaA__ADK90200__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucgcguucgaggccaccggcaaccucguggucccccgguacgccuucgccauggagcgcaacgccggguccggcaucaucaucagcgacacccccgugcacgacugcaacacgaccugccagaccccgaagggcgcgaucaacaccucccugcccuuccagaacauccaccccaucacgaucgggaagugccccaaguacgucaagucgaccaagcugcggcucgccaccggccugcgcaacgugccguccauccagagccgggggcuguucggcgccaucgccggguucaucgagggcggcuggaccgggaugguggacggcugguacggguaccaccaccagaacgagcagggcuccggguacgccgcggaccucaagucgacgcagaacgccaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggcgaagcugaaccgggaggagaucgacggcgugaagcucgagagcacccgcaucuaccagauccuggccgucuacuccaccguggccucgagccuggugcucgucgugucccugggggccaucucguucuggaugugcuccaacggcagccugcagugccggaucugcaucuga

SEQ ID NO: 5587 - RNA, 1701 nt, Artificial Sequence
  derived and/or modified CDS sequence (AUadapt) from InfluenzaA__ADK90201__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccguccgcccgaaggugcgggaccaggagggccgcaugaacuacuacuggacccugguggagcccggggacaagaucaccuucgaggcgaccggcaaccucgucgugccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggucaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgucaagcucgagagcacccgcaucuaccagauccuggcgaucuacuccaccguggccucgagccuggugcucgucgugucccugggggccaucucguucuggaugugcuccaacggcagccugcagugccggaucugcaucuga

SEQ ID NO: 5588 - RNA, 1701 nt, Artificial Sequence
  derived and/or modified CDS sequence (AUadapt) from InfluenzaA__ADK90202__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagccccugucgaccgcguccagcugguccuacaucguggagaccucguccagcgacaacggcacgugcuaccccggcgacuucaucgacuacgaggagcuccgggagcagcuguccucgguguccucguucgagcgccuggagaucuuccccaagaccuccagcuggccgaaccacgacuccaacaagggggucaccgccgccugcccccacgccggcgccaagucguucuacaagaaccucaucuggcuggugaagaaggggaacuccuaccccaagcugagcaaguccuacaucaacgacaagggcaaggaggugcucguccugugggggauccaccaccccucgaccagcgccgaccagcagucccuguaccagaacgccgacgccuacguguucgugggcacgucgcgguacuccaagaaguucaagccggagaucgccauccgccccaagguccgggaccaggagggccgcaugaacuacuacuggacccucguggagcccggggacaagaucaccuucgaggcgaccggcaaccugguggucccccgguacgccuucgccauggagcgcaacgccgggucgggcaucaucaucuccgacacgccggugcacgacugcaacacgaccugccagacccccaacggcgccaucaacaccagccugcccuuccagaacauccaccccaucaccaucgggaagugcccgaaguacgugaaguccaccaagcuccggcuggcgaccggccugcgcaacguccccucgauccagucccggggccucuucggggccaucgccggguucaucgagggcggcuggacggggaugguggacggcugguacggguaccaccaccagaacgagcagggcagcggguacgccgccgaccugaaguccacccagaacgcgaucgacgagaucaccaacaaggugaacucggucaucgagaagaugaacacccaguucacggccgugggcaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacuccaacgugaagaaccuguacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcucaaccgggaggagaucgacggcgugaagcuggaguccacccgcaucuaccagauccuggcgaucuacucgaccgucgccuccagccucgugcugguggucucgcugggggccaucuccuucuggaugugcagcaacggcucccuccagugccggaucugcaucuga

SEQ ID NO: 5589 - RNA, 1701 nt, Artificial Sequence; identical to SEQ ID NO: 96
  derived and/or modified CDS sequence (AUadapt) from InfluenzaA__ADK90203__HA

SEQ ID NO: 5590 - RNA, 1701 nt, Artificial Sequence; identical to SEQ ID NO: 4015
  derived and/or modified CDS sequence (AUadapt) from InfluenzaA__ADK90204__HA

SEQ ID NO: 5591 - RNA, 1701 nt, Artificial Sequence
  derived and/or modified CDS sequence (AUadapt) from InfluenzaA__ADK94191__HA
augaagaccaucaucgcccugucguacauccucugccugguguucgcccagaagcugcccggcaacgacaacuccaccgcgacgcucugccuggggcaccacgccgucccgaacggcaccguggugaagaccaucaccaacgaccagaucgaggucacgaacgccaccgagcuggugcagucguccagcaccggggagaucugcgacucgccccaccagauccucgacggcaagaacugcacccugaucgacgcccugcucggggacccccagugcgacggcuuccagaacaagaagugggaccuguucguggagcgcagcaaggccuacuccaacugcuaccccuacgacgucccggacuacgcgucgcugcggucccucguggccagcuccggcacgcuggaguucaacaacgagucguucaacuggaccggggugacccagaacggcaccuccucggccugcauccgccgguccaagaacagcuucuucucccgccugaacuggcucacgcaccugaacuucaaguaccccgcccugaacgucaccaugcccaacaacgagcaguucgacaagcucuacaucuggggcgugcaccaccccgggaccgacaaggaccagaucuuccuguacgcgcaggccucggggcggaucaccguguccacgaagcgcagccagcagaccgucaucccgaacaucggcucgcggccccgcgugcggaacauccccucccgcgugagcaucuacuggaccaucgucaagcccggcgacauccugcucaucaacuccaccgggaaccugaucgccccgcggggcuacuucaagauccgcucggggaaguccucgaucaugcgguccgacgcccccaucggcaagugcaacagcgagugcaucacgcccaacggcuccauccccaacgacaagccguuccagaacgugaaccgcaucaccuacggggccugcccccgguacgugaagcagaacacccugaagcucgcgaccggcaugcgcaacguccccgagaagcagacgcgggggaucuucggcgccaucgccggguucaucgagaacggcugggagggcaugguggacgggugguacggcuuccgccaccagaacucggaggggcggggccaggccgccgaccugaaguccacccaggcggccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacacgaucgaccucaccgacucggagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacguguaccgggacgaggcccucaacaaccgcuuccagaucaagggggucgagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 5592 - RNA, 1701 nt, Artificial Sequence
  derived and/or modified CDS sequence (AUadapt) from InfluenzaA__ADK94202__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucaucgccagcuccggcacgcuggaguucaacaacgagucguucaacuggaccggggucacccagaacggcaccuccucggccugcauccgccgguccaacaacagcuucuucucccgccugaacuggcucacgcaccugaaguucaaguaccccgcccugaacgugaccaugcccaacaacgagcaguucgacaagcucuacaucuggggcgugcaccaccccgggaccgacaacgaccagaucuuccuguacgcgcaggccucggggcggaucaccgucuccacgaagcgcagccagcagaccgugaucccgaacaucggcucgcggccccgcgugcggaacauccccucccgcaucagcaucuacuggaccaucgucaagcccggcgacauccugcucaucaacuccaccgggaaccugaucgccccgcggggcuacuucaagauccgcucggggaaguccucgaucaugcgguccgacgcccccaucggcaagugcaacagcgagugcaucacgcccaacggcuccauccccaacgacaagccguuccagaacgugaaccgcaucaccuacggggccugcccccgguacgugaagcagaacacccugaagcucgcgaccggcaugcgcaacguccccgagaagcagacgcgggggaucuucggcgccaucgccggguucaucgagaacggcugggagggcaugguggacgggugguacggcuuccgccaccagaacucggaggggcggggccaggccgccgaccugaaguccacccaggcggccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacacgaucgaccucaccgacucggagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacguguaccgggacgaggcccucaacaaccgcuuccagaucaagggggucgagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 5593 - RNA, 1701 nt, Artificial Sequence; identical to SEQ ID NO: 2679
  derived and/or modified CDS sequence (AUadapt) from InfluenzaA__ADK94213__HA

SEQ ID NO: 5594 - RNA, 1701 nt, Artificial Sequence; identical to SEQ ID NO: 3858
  derived and/or modified CDS sequence (AUadapt) from InfluenzaA__ADK94224__HA

SEQ ID NO: 5595 - RNA, 1701 nt, Artificial Sequence
  derived and/or modified CDS sequence (AUadapt) from InfluenzaA__ADK94257__HA
auggagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaagaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcagaccgugaucccgaacaucggcagccggccccgcguccggaacauccccucccgcaucucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagucgacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggcggggccaggccgccgaccugaaguccacccaggcggccaucgaccagaucaacgggaagcugaaccgccucaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgcgugcaucgggucgauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 5596 - RNA, 1701 nt, Artificial Sequence
  derived and/or modified CDS sequence (AUadapt) from InfluenzaA__ADK94268__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaagaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcagaccgugaucccgaacaucggcagccggccccgcguccggaacauccccucccgcaucucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagucgacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggcggggccaggccgccgaccugaaguccacccaggcggccaucgaccagaucaacgggaagcugaaccgccucaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgcgugcaucgggucgauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 5597 - RNA, 1701 nt, Artificial Sequence
  derived and/or modified CDS sequence (AUadapt) from InfluenzaA__ADK94279__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccucggggcggaucaccguguccacgaagcgcagccagcagaccgugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggcggggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 5598 - RNA, 1701 nt, Artificial Sequence; identical to SEQ ID NO: 3858
  derived and/or modified CDS sequence (AUadapt) from InfluenzaA__ADK94290__HA

SEQ ID NO: 5599 - RNA, 1701 nt, Artificial Sequence; identical to SEQ ID NO: 3858
  derived and/or modified CDS sequence (AUadapt) from InfluenzaA__ADK94301__HA

SEQ ID NO: 5600 - RNA, 1701 nt, Artificial Sequence
  derived and/or modified CDS sequence (AUadapt) from InfluenzaA__ADK94323__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaagaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccucggggcggaucaccguguccacgaagcgcagccagcagaccgugaucccgaacaucggcucgcggccccgcauccggaacauccccucccgcaucagcaucuacuggaccaucgucaagcccggcgacauccugcucaucaacuccaccgggaaccugaucgccccgcggggcuacuucaagauccgcucggggaaguccucgaucaugcgguccgacgcccccaucggcaagugcaacagcgagugcaucacgcccaacggcuccauccccaacgacaagccguuccagaacgugaaccgcaucaccuacggggccugcccccgguacgugaagcagaacacccugaagcucgcgaccggcaugcgcaacguccccgagaagcagacgcgggggaucuucggcgccaucgccggguucaucgagaacggcugggagggcaugguggacgggugguacggcuuccgccaccagaacucggaggggcggggccaggccgccgaccugaaguccacccaggcggccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacacgaucgaccucaccgacucggagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacguguaccgggacgaggcccucaacaaccgcuuccagaucaagggggucgagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 5601 - RNA, 1701 nt, Artificial Sequence; identical to SEQ ID NO: 5591
  derived and/or modified CDS sequence (AUadapt) from InfluenzaA__ADK94441__HA

SEQ ID NO: 5602 - RNA, 1701 nt, Artificial Sequence
  derived and/or modified CDS sequence (AUadapt) from InfluenzaA__ADK94476__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcaagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagucguucaacuggaccggggugacccagaacggcaccuccagcgccugcauccgccgguccaagaacucguucuucucccgccugaacuggcucacgcaccugaacuucaaguaccccgcccugaacgugaccaugcccaacaacgagcaguucgacaagcucuacaucuggggcgcgcaccaccccgggaccgacaaggaccagaucuuccuguacgcccaggccucggggcggaucaccgucuccacgaagcgcagccagcagaccgugaucccgaacaucggcucgcggccccgcgugcggaacauccccucccgcaucucgaucuacuggaccaucgucaagcccggcgacauccugcucaucaacuccaccgggaaccugaucgccccgcggggcuacuucaagauccgcagcgggaaguccucgaucaugcgguccgacgcccccaucggcaagugcaacucggagugcaucacgcccaacggcuccauccccaacgacaagccguuccagaacgugaaccgcaucaccuacggggcgugcccccgguacgugaagcagaacacccugaagcucgccaccggcaugcgcaacguccccgagaagcagacgcgggggaucuucggcgccaucgccggguucaucgagaacggcugggagggcaugguggacgggugguacggcuuccgccaccagaacagcgaggggcggggccaggccgcggaccugaaguccacccaggccgccaucgaccagaucaacgggaagcugaaccgccucaucggcaagaccaacgagaaguuccaccagaucgagaaggaguucucggagguggagggccggauccaggaccuggagaaguacgucgaggacaccaagaucgaccugugguccuacaacgccgagcuccugguggcccuggagaaccagcacacgaucgaccucaccgacucggagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacguguaccgggacgaggcccucaacaaccgcuuccagaucaagggggucgagcugaaguccggcuacaaggacuggauccuguggaucuccuucgccaucagcugcuuccuccugugcguggcccugcucggcuucaucaugugggcgugccagaaggggaacauccggugcaacaucugcaucuga

SEQ ID NO: 5603 - RNA, 1701 nt, Artificial Sequence; identical to SEQ ID NO: 3858
  derived and/or modified CDS sequence (AUadapt) from InfluenzaA__ADK94487__HA

SEQ ID NO: 5604 - RNA, 1701 nt, Artificial Sequence
  derived and/or modified CDS sequence (AUadapt) from InfluenzaA__ADK94498__HA
augaagaccaucaucgcccugucguacauccucugccugguguucgcccagaagcugcccggcaacgacaacuccaccgcgacgcucugccuggggcaccacgccgucccgaacggcaccguggugaagaccaucaccaacgaccagaucgaggucacgaacgccaccgagcuggugcagucguccagcaccggggagaucugcgacucgccccaccagauccucgacggcaagaacugcacccugaucgacgcccugcucggggacccccagugcgacggcuuccagaacaagaagugggaccuguucguggagcgcagcaaggccuacuccaacugcuaccccuacgacgucccggacuacgcgucgcugcggucccucguggccagcuccggcacgcuggaguucaacaacgagucguucaacuggaccggggugacccagaacggcaccuccucggccugcauccgccgguccaagaacagcuucuucucccgccugaacuggcucacgcaccugaacuucaaguaccccgcccugaacgucaccaugcccaacaacgagcaguucgacaagcucuacaucuggggcgugcaccaccccgggaccgacaaggaccagaucuuccuguacgcgcaggccucggggcggaucaccguguccacgaagcgcagccagcagaccgucaucccgaacaucggcucgcggccccgcgugcggaacauccccucccgcaucagcaucuacuggaccaucgugaagcccggcgacauccugcucaucaacuccaccgggaaccugaucgccccgcggggcuacuucaagauccgcucggggaaguccucgaucaugcgguccgacgcccccaucggcaagugcaacagcgagugcaucacgcccaacggcuccauccccaacgacaagccguuccagaacgucaaccgcaucaccuacggggccugcccccgguacgugaagcagaacacccugaagcucgcgaccggcaugcgcaacgugcccgagaagcagacgcgggggaucuucggcgccaucgccggguucaucgagaacggcugggagggcauggucgacgggugguacggcuuccgccaccagaacucggaggggcggggccaggccgccgaccugaaguccacccaggcggccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcccuggagaaccagcacacgaucgaccucaccgacucggagaugaacaagcuguucgagaagaccaagaagcagcugcgcgagaacgccgaggacauggggaacggcugcuucaagaucuaccacaagugcgacaacgcgugcaucggguccauccgcaacggcaccuacaaccacgacguguaccgggacgaggcccucaacaaccgcuuccagaucaaggggguggagcugaaguccggcuacaaggacuggauccuguggaucuccuucgccaucagcugcuuccuccugugcgucgcccugcucggcuucaucaugugggccugccagaaggggaacauccggugcaacaucugcaucuga

SEQ ID NO: 5605 - RNA, 1701 nt, Artificial Sequence
  derived and/or modified CDS sequence (AUadapt) from InfluenzaA__ADK94509__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcaagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaagaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcagaccgccaucccgaacaucggcucgcggccccgcgugcggaacauccccucccgcaucagcaucuacuggaccaucgucaagcccggcgacauccugcucaucaacuccaccgggaaccugaucgccccgcggggcuacuucaagauccgcucggggaaguccagcaucaugcgguccgacgcccccaucggcaagugcaacucggagugcaucacgcccaacggcuccauccccaacgacaagccguuccagaacgugaaccgcaucaccuacggggcgugcccccgguacaucaagcagaacacccugaagcucgccaccggcaugcgcaacgugcccgagaagcagacgcgggggaucuucggcgccaucgccggguucaucgagaacggcugggagggcauggucgacgggugguacggcuuccgccaccagaacucggaggggcggggccaggccgcggaccugaaguccacccaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcccuggagaaccagcacacgaucgaccucaccgacucggagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcccugcucggcuucaucaugugggcgugccagaaggggaacauccggugcaacaucugcaucuga

SEQ ID NO: 5606 - RNA, 1701 nt, Artificial Sequence
  derived and/or modified CDS sequence (AUadapt) from InfluenzaA__ADK94520__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucaucgccagcuccggcacgcuggaguucaacaacgagucguucaacuggaccggggucacccagaacggcaccuccucggccugcauccgccgguccaacaacagcuucuucucccgccugaacuggcucacgcaccuccgguucaaguaccccgcccugaacgugaccaugcccaacaacgagcaguucgacaagcuguacaucuggggcgugcaccaccccgggaccgacaacgaccagaucuuccuguacgcgcaggccucggggcgcaucaccgucuccacgaagcggagccagcagaccgugaucccgaacaucggcucgcgcccccgggugcgcaacauccccucccggaucagcaucuacuggaccaucgucaagcccggcgacauccugcucaucaacuccaccgggaaccugaucgccccgcgcggcuacuucaagauccggucggggaaguccucgaucaugcgcuccgacgcccccaucggcaagugcaacagcgagugcaucacgcccaacggcuccauccccaacgacaagccguuccagaacgugaaccggaucaccuacggggccugcccccgcuacgugaagcagaacacccugaagcucgcgaccggcaugcggaacguccccgagaagcagacgcgcgggaucuucggcgccaucgccggguucaucgagaacggcugggagggcaugguggacgggugguacggcuuccggcaccagaacucggaggggcgcggccaggccgccgaccugaaguccacccaggcggccaucgaccagaucaacgggaagcugaaccggcucaucggcaagaccaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacacgaucgaccucaccgacucggagaugaacaagcuguucgagaagaccaagaagcagcugcgcgagaacgccgaggacauggggaacggcugcuucaagaucuaccacaagugcgacaacgcgugcaucggguccauccggaacggcaccuacgaccacgacguguaccgcgacgaggcccucaacaaccgguuccagaucaagggggucgagcugaaguccggcuacaaggacuggauccuguggaucuccuucgccaucagcugcuuccuccugugcguggcccugcucggcuucaucaugugggccugccagaaggggaacaucaagugcaacaucugcaucuga

SEQ ID NO: 5607 - RNA, 1701 nt, Artificial Sequence; identical to SEQ ID NO: 3858
  derived and/or modified CDS sequence (AUadapt) from InfluenzaA__ADK94531__HA

SEQ ID NO: 5608 - RNA, 1701 nt, Artificial Sequence; identical to SEQ ID NO: 2679
  derived and/or modified CDS sequence (AUadapt) from InfluenzaA__ADK94542__HA

SEQ ID NO: 5609 - RNA, 1701 nt, Artificial Sequence
  derived and/or modified CDS sequence (AUadapt) from InfluenzaA__ADK94553__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaagaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcagaccgugaucccgaacaucggcagccggccccgcguccggaacauccccucccgcaucucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagucgacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggcggggccaggccgccgaccugaaguccacccaggcggccaucgaccagaucaacgggaagcugaaccgccucaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgccgaggacauggggaacggcugcuucaagaucuaccacaagugcaacaacgcgugcaucgggucgauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 5610 - RNA, 1701 nt, Artificial Sequence; identical to SEQ ID NO: 3858
  derived and/or modified CDS sequence (AUadapt) from InfluenzaA__ADK94564__HA

SEQ ID NO: 5611 - RNA, 1701 nt, Artificial Sequence
  derived and/or modified CDS sequence (AUadapt) from InfluenzaA__ADK98501__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccggcaacggcacgugcuaccccggggacuucaucgacuacgaggagcuccgggagcagcugucguccgugagcuccuucgagcgcuucgagaucuuccccaagaccucguccuggcccaaccacgacagcaacaagggcgucaccgccgccugcccgcacgccggggcgaaguccuucuacaagaaccugaucuggcucgugaagaagggcaacucguaccccaagcuguccaagagcuacaucaacgacaaggggaaggaggugcugguccucuggggcauccaccaccccucgaccuccgccgaccagcagagccuguaccagaacgccgacgccuacguguucgugggcacgucccgguacucgaagaaguucaagcccgagaucgccauccgcccgaagguccgggaccaggaggggcgcaugaacuacuacuggacccugguggagcccggcgacaagaucaccuucgagaccacggggaaccucguggucccccgguacgcguucgccauggagcgcaacgccggcuccggcaucaucaucagcgacacccccgugcacgacugcaacacgaccugccagaccccgaagggggccaucaacaccucccugcccuuccagaacauccaccccaucaccaucggcaagugccccaaguacgucaagucgaccaagcugcggcucgccacggggcugcgcaacgugccguccauccagagccggggccuguucggggcgaucgccggcuucaucgagggcggguggaccggcaugguggacgggugguacggcuaccaccaccagaacgagcagggguccggcuacgccgccgaccucaagucgacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcucgagagcacccgcaucuaccagauccuggccaucuacuccaccgucgcgucgagccuggugcucguggucucccugggcgccaucucguucuggaugugcuccaacggcagccugcagugccggaucugcaucuga

SEQ ID NO: 5612 - RNA, 1701 nt, Artificial Sequence
  derived and/or modified CDS sequence (AUadapt) from InfluenzaA__ADK98503__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacccgaacaagggggucaccgccgccugcccccacgccggcgccaagucguucuacaagaaccugaucuggcucgugaagaaggggaacuccuaccccaagcugagcaaguccuacaucaacgacaagggcaaggaggugcugguccucugggggauccaccaccccucgaccagcgccgaccagcagucccuguaccagaacguggacgccuacguguucgucggcacgucgcgguacuccaagaaguucaagccggagaucgccauccgccccaaggugcgggaccaggagggccgcaugaacuacuacuggacccugguggagcccggggacaagaucaccuucgaggccaccggcaaccucgucgugccccgguacgcguucgccauggagcgcaacgccgggagcggcaucaucaucuccgacacgccggugcacgacugcaacacgaccugccagacccccaagggcgccaucaacaccucgcugcccuuccagaacauccaccccaucaccaucgggaagugcccgaaguacgucaaguccaccaagcugcggcucgccaccggccugcgcaacgugcccagcauccagucccgggggcuguucggcgcgaucgccggguucaucgagggcggcuggacggggaugguggacggcugguacggguaccaccaccagaacgagcagggcucgggguacgccgccgaccucaaguccacccagaacgccaucgacgagaucaccaacaaggucaacagcgugaucgagaagaugaacacccaguucacggcggucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacuccaacgucaagaaccucuacgagaaggugcgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgucaagcucgaguccacccgcaucuaccagauccuggccaucuacucgaccguggcguccagccuggugcucgucgugucgcugggggccaucuccuucuggaugugcagcaacggcucccugcagugccggaucugcaucuga

SEQ ID NO: 5613 - RNA, 1701 nt, Artificial Sequence; identical to SEQ ID NO: 5596
  derived and/or modified CDS sequence (AUadapt) from InfluenzaA__ADK98623__HA

SEQ ID NO: 5614 - RNA, 1701 nt, Artificial Sequence; identical to SEQ ID NO: 2679
  derived and/or modified CDS sequence (AUadapt) from InfluenzaA__ADK98634__HA

SEQ ID NO: 5615 - RNA, 1701 nt, Artificial Sequence; identical to SEQ ID NO: 2679
  derived and/or modified CDS sequence (AUadapt) from InfluenzaA__ADK98645__HA

SEQ ID NO: 5616 - RNA, 1701 nt, Artificial Sequence; identical to SEQ ID NO: 5542
  derived and/or modified CDS sequence (AUadapt) from InfluenzaA__ADK98656__HA

SEQ ID NO: 5617 - RNA, 1701 nt, Artificial Sequence; identical to SEQ ID NO: 5609
  derived and/or modified CDS sequence (AUadapt) from InfluenzaA__ADK98667__HA

SEQ ID NO: 5618 - RNA, 1701 nt, Artificial Sequence
  derived and/or modified CDS sequence (AUadapt) from InfluenzaA__ADK98678__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccucggggcggaucaccguguccacgaagcgcagccagcagaccgugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccucgaucaugcgguccgacgcccccaucggcaagugcaacagcgagugcaucacgcagaacggcuccauccccaacgacaagcccuuccagaacgugaaccgcaucaccuacggggccugcccgcgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggcggggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 5619 - RNA, 1701 nt, Artificial Sequence; identical to SEQ ID NO: 2679
  derived and/or modified CDS sequence (AUadapt) from InfluenzaA__ADK98689__HA

SEQ ID NO: 5620 - RNA, 1701 nt, Artificial Sequence; identical to SEQ ID NO: 2679
  derived and/or modified CDS sequence (AUadapt) from InfluenzaA__ADK98700__HA

SEQ ID NO: 5621 - RNA, 1701 nt, Artificial Sequence; identical to SEQ ID NO: 2679
  derived and/or modified CDS sequence (AUadapt) from InfluenzaA__ADK98711__HA

SEQ ID NO: 5622 - RNA, 1701 nt, Artificial Sequence
  derived and/or modified CDS sequence (AUadapt) from InfluenzaA__ADK98722__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccucggggcggaucaccguguccacgaagggcagccagcagaccgugaucccgaacaucggcucgcgcccccggguccgcaacauccccucccggaucagcaucuacuggaccaucgugaagcccggggacauccugcucaucaacuccaccggcaaccugaucgccccgcgcggguacuucaagauccggucgggcaaguccucgaucaugcgcuccgacgcccccaucggcaagugcaacagcgagugcaucacgcccaacggguccauccccaacgacaagccguuccagaacgugaaccggaucaccuacggcgccugcccccgcuacgucaagcagaacacccugaagcucgcgaccgggaugcggaacgugcccgagaagcagacgcgcggcaucuucggggccaucgccggcuucaucgagaacggcugggaggggaugguggacggcugguacggguuccggcaccagaacucggagggccgcgggcaggccgccgaccugaaguccacccaggcggccaucgaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgggagaacgccgaggacaugggcaacgggugcuucaagaucuaccacaagugcgacaacgcgugcaucggcuccauccgcaacgggaccuacgaccacgacgucuaccgcgacgaggcccucaacaaccgguuccagaucaagggcguggagcugaaguccggcuacaaggacuggauccuguggaucuccuucgccaucagcugcuuccuccugugcguggcccugcucggguucaucaugugggccugccagaagggcaacauccgcugcaacaucugcaucuga

SEQ ID NO: 5623 - RNA, 1701 nt, Artificial Sequence; identical to SEQ ID NO: 5596
  derived and/or modified CDS sequence (AUadapt) from InfluenzaA__ADK98733__HA

SEQ ID NO: 5624 - RNA, 1701 nt, Artificial Sequence; identical to SEQ ID NO: 2679
  derived and/or modified CDS sequence (AUadapt) from InfluenzaA__ADK98744__HA

SEQ ID NO: 5625 - RNA, 1701 nt, Artificial Sequence; identical to SEQ ID NO: 2679
  derived and/or modified CDS sequence (AUadapt) from InfluenzaA__ADK98777__HA

SEQ ID NO: 5626 - RNA, 1701 nt, Artificial Sequence; identical to SEQ ID NO: 2679
  derived and/or modified CDS sequence (AUadapt) from InfluenzaA__ADK98788__HA

SEQ ID NO: 5627 - RNA, 1701 nt, Artificial Sequence; identical to SEQ ID NO: 3858
  derived and/or modified CDS sequence (AUadapt) from InfluenzaA__ADK98799__HA

SEQ ID NO: 5628 - RNA, 1701 nt, Artificial Sequence
  derived and/or modified CDS sequence (AUadapt) from InfluenzaA__ADK98810__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacucguucuucucccgccugaacuggcucacgcaccugaaguucaaguaccccgcccugaacgugaccaugcccaacaacgagcaguucgacaagcucuacaucuggggcguccaccaccccgggaccgacaacgaccagaccuuccuguacgcgcaggccagcgggcggaucacgguguccaccaagcgcucgcagcagaccgugaucccgaacaucggcucgcggccccgcguccggaacauccccucccgcaucagcaucuacuggaccaucgugaagcccggcgacauccugcucaucaacuccacggggaaccugaucgccccgcggggcuacuucaagauccgcucggggaaguccagcaucaugcgguccgacgcccccaucggcaagugcaacucggagugcaucacccccaacggcuccauccccaacgacaagccguuccagaacgugaaccgcaucaccuacggggccugcccccgguacgucaagcagaacacccugaagcucgcgacgggcaugcgcaacgugcccgagaagcagacccgggggaucuucggcgccaucgccggguucaucgagaacggcugggagggcaugguggacgggugguacggcuuccgccaccagaacucggaggggcggggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacacgaagaucgaccugugguccuacaacgccgagcuccugguggcccuggagaaccagcacaccaucgaccucaccgacucggagaugaacaagcuguucgagaagaccaagaagcagcugcgcgagaacgccgaggacauggggaacggcugcuucaagaucuaccacaagugcgacaacgcgugcaucggguccauccgcaacggcacguacgaccacaacgucuaccgggacgaggcccucaacaaccgcuuccagaucaaggagguggagcugaaguccggguacaaggacuggauccuguggaucuccuucgccaucagcugcuuccuccugugcguggcccugcucggcuucaucaugugggccugccagaagggcaacauccggugcaacaucugcaucuga

SEQ ID NO: 5629 - RNA, 1701 nt, Artificial Sequence
  derived and/or modified CDS sequence (AUadapt) from InfluenzaA__ADK98821__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcaagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaagaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcagaccgccaucccgaacaucggcucgcggccccgcgugcggaacauccccucccgcaucagcaucuacuggaccaucgucaagcccggcgacauccugcucaucaacuccaccgggaaccugaucgccccgcggggcuacuucaagauccgcucggggaaguccagcaucaugcgguccgacgcccccaucggcaagugcaacucggagugcaucacgcccaacggcuccauccccaacgacaagccguuccagaacgugaaccgcaucaccuacggggcgugcccccgguacgugaagcagaacacccugaagcucgccaccggcaugcgcaacguccccgagaagcagacgcgggggaucuucggcgccaucgccggguucaucgagaacggcugggagggcaugguggacgggugguacggcuuccgccaccagaacucggaggggcggggccaggccgcggaccugaaguccacccaggccgccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacacgaucgaccucaccgacucggagaugaacaagcuguucgagaagacccgcaagcagcugcgcgagaacgcggaggacauggggaacggcugcuucaagaucuaccacaagugcgacaacgccugcaucggguccauccggaacggcaccuacgaccacgacguguaccgcgacgaggcccucaacaaccgguuccagaucaagggggucgagcugaaguccggcuacaaggacuggauccuguggaucuccuucgccaucagcugcuuccuccugugcguggcccugcucggcuucaucaugugggcgugccagaaggggaacauccgcugcaacaucugcaucuga

SEQ ID NO: 5630 - RNA, 1701 nt, Artificial Sequence; identical to SEQ ID NO: 2679
  derived and/or modified CDS sequence (AUadapt) from InfluenzaA__ADK98832__HA

SEQ ID NO: 5631 - RNA, 1701 nt, Artificial Sequence; identical to SEQ ID NO: 5609
  derived and/or modified CDS sequence (AUadapt) from InfluenzaA__ADK98843__HA

SEQ ID NO: 5632 - RNA, 1701 nt, Artificial Sequence
  derived and/or modified CDS sequence (AUadapt) from InfluenzaA__ADK98854__HA
augaagaccaucaucgcccugucguacauccucugccugguguucacccagaagcugcccggcaacgacaacuccacggccacccucugccuggggcaccacgcggucccgaacggcaccaucgugaagaccaucacgaacgaccagaucgaggugaccaacgccaccgagcugguccagucguccagcaccggggagaucugcgacucgccccaccagauccucgacggcgagaacugcacgcugaucgacgcccugcucggggacccccagugcgacggcuuccagaacaagaagugggaccuguucguggagcgcuccaaggccuacuccaacugcuaccccuacgacgugccggacuacgccagccugcggucccucgucgcgucguccggcacccuggaguucaacaacgagucguucaacuggaccggggugacccagaacggcacguccagcgccugcauccgccgguccaacaacucguucuucucccgccugaacuggcucacccaccugaaguucaaguaccccgcccugaacgugaccaugcccaacaacgagcaguucgacaagcucuacaucuggggcguccaccaccccgggaccgacaacgaccagaucuuccuguacgcccaggcgagcgggcggaucacgguguccaccaagcgcucgcagcagaccgugaucccgaacaucggcucgcggccccgcguccggaacauccccucccgcaucagcaucuacuggaccaucgugaagcccggcgacauccugcucaucaacuccacggggaaccugaucgccccgcggggcuacuucaagauccgcucggggaaguccagcaucaugcgguccgacgcccccaucggcaagugcaacucggagugcaucacccccaacggcuccauccccaacgacaagccguuccagaacgugaaccgcaucaccuacggggccugcccccgguacgucaagcagaacacccugaagcucgccacgggcaugcgcaacgugcccgagaagcagacccgggggaucuucggcgcgaucgccggguucaucgagaacggcugggagggcaugguggacgggugguacggcuuccgccaccagaacucggaggggcggggccaggccgccgaccugaaguccacccaggccgcgaucgaccagaucaacgggaagcugaaccgccucaucggcaagaccaacgagaaguuccaccagaucgagaaggaguucagcgaggucgagggccggauccaggaccuggagaaguacguggaggacacgaagaucgaccugugguccuacaacgccgagcuccugguggcccuggagaaccagcacaccaucgaccucaccgacucggagaugaacaagcuguucgagaagaccaagaagcagcugcgcgagaacgccgaggacauggggaacggcugcuucaagaucuaccacaagugcgacaacgccugcaucggguccauccgcaacggcacguacgaccacgacgucuaccgggacgaggcgcucaacaaccgcuuccagaucaaggggguggagcugaagcccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 5633 - RNA, 1701 nt, Artificial Sequence
  derived and/or modified CDS sequence (AUadapt) from InfluenzaA__ADK98865__HA
augaagaccaucaucgcccugucguacauccucugccugguguucgcccagaagcugcccggcuccgacaacagcaccgcgacgcucugccuggggcaccacgccgucccgaacggcaccaucgugaagaccaucaccaacgaccagaucgaggugacgaacgccaccgagcugguccaguccucguccaccggggagaucugcgacagcccccaccagauccucgacggcgagaacugcacccugaucgacgcccugcucggggacccccagugcgacgacuuccagaacaagaagugggaccuguucguggagcgcuccaaggccuacucgaacugcuaccccuacgacgugccggacuacgcgucccugcggagccucgucgccuccucgggcacgcuggaguucaacaacgaguccuucaacuggaccggcgugacccagaacgggaccagcuccgccugcauccgccggucguccaacagcuucuucucccgccugaacuggcucacgcaccuccgguucaaguaccccgcccugaacgugaccaugcccaacaacgagcaguucgacaagcuguacaucuggggcguccaccaccccgggaccgacaacgaccagaucuuccuguacgcgcaggccucgggccgcaucaccgugagcacgaagcggucccagcagaccgugaucccgaacaucgggucgcgcccccggguccgcaacauccccucccggaucagcaucuacuggaccaucgugaagcccggcgacauccugcucaucaacuccaccggcaaccugaucgccccgcgcggguacuucaagauccggucgggcaaguccagcaucaugcgcuccgacgcccccaucgggaagugcaacucggagugcaucacgcccaacggcuccauccccaacgacaagccguuccagaacgugaaccggaucaccuacggcgccugcccccgcuacgucaagcagaacacccugaagcucgcgaccgggaugcggaacgugcccgagaagcagacgcgcggcaucuucggggccaucgccggcuucaucgagaacgggugggagggcaugguggacggcugguacggguuccggcaccagaacagcgagggccgcgggcaggccgccgaccugaaguccacccaggcggccaucgaccagaucaacggcaagcugaaccggcucaucgggaagaccaacgagaaguuccaccagaucgagaaggaguucucggaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacaugggcaacgggugcuucaagaucuaccacaagugcgacaacgcgugcaucggcuccauccggaacgggaccuacgaccacgacgucuaccgcgacgaggcccucaacaaccgguuccagaucaagggcguggagcucaagucgggguacaaggacuggauccuguggaucuccuucgccaucagcugcuuccugcugugcguggcccugcucggcuucaucaugugggccugccagaagggcaacauccgcugcaacaucugcaucuga

SEQ ID NO: 5634 - RNA, 1701 nt, Artificial Sequence
  derived and/or modified CDS sequence (AUadapt) from InfluenzaA__ADK98876__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacucguccaccggggagaucugcgacagcccccaccagauccucgacggcaagaacugcacccugaucgacgcccugcucggggacccccagugcgacggcuuccagaacaagaagugggaccuguucguggagcgcuccaaggccuacucgaacugcuaccccuacgacgugccggacuacgcgucccugcggagccucgucgccuccucgggcacgcuggaguucaacaacgaguccuucaacuggaccggggugacccagaacggcaccucguccgccugcauccgccggagcaagaacuccuucuucucgcgccugaacuggcucacgcaccugaacuucaaguaccccgcccugaacgugaccaugcccaacaacgggcaguucgacaagcucuacaucuggggcguccaccaccccgggaccgacaaggaccagaucuuccuguacgcgcaggccuccggccggaucaccgugagcacgaagcgcucccagcagaccgugaucccgaacaucggcucgcggccccgcguccggaacauccccucgcgcaucuccaucuacuggaccaucgugaagcccggggacauccugcucaucaacagcaccggcaaccugaucgccccgcggggguacuucaagauccgcuccggcaagucguccaucaugcggagcgacgcccccaucggcaagugcaacuccgagugcaucacgcccaacgggucgauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacuccgagggccgggggcaggccgccgaccucaagucgacccaggcggccaucgaccagaucaacggcaagcugaaccgccugaucggcaagaccaacgagaaguuccaccagaucgagaaggaguucuccgaggucgaggggcggauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgccgaggacaugggcaacgggugcuucaagaucuaccacaagugcgacaacgcgugcaucggcucgauccgcaacgggaccuacgaccacgacgucuaccgggacgaggcccucaacaaccgcuuccagaucaagggcguggagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 5635 - RNA, 1701 nt, Artificial Sequence; identical to SEQ ID NO: 5609
  derived and/or modified CDS sequence (AUadapt) from InfluenzaA__ADK98887__HA

SEQ ID NO: 5636 - RNA, 1701 nt, Artificial Sequence; identical to SEQ ID NO: 2679
  derived and/or modified CDS sequence (AUadapt) from InfluenzaA__ADK98898__HA

SEQ ID NO: 5637 - RNA, 1701 nt, Artificial Sequence
  derived and/or modified CDS sequence (AUadapt) from InfluenzaA__ADK98909__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucucguccaccggggagaucugcgacagcccccaccagauccucgacggcgagaacugcacccugaucgacgcccugcucggggacccccagugcgacggcuuccagaacaagaagugggaccuguucguggagcgcuccaaggccuacucgaacugcuaccccuacgacgugccggacuacgcgucccugcggagccucgucgccuccucgggcacgcuggaguucaacaacgaguccuucaacuggaccggggugacccagaacggcaccagcuccgccugcauccgccggucgaacaacuccuucuucagccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccuccgggcggaucaccgugucgacgaagcgcucccagcagaccgugaucccgaacaucggcucgcggccccgcguccggaacauccccagccgcaucuccaucuacuggaccaucgugaagcccggcgacauccugcucaucaacucgaccgggaaccugaucgccccgcggggcuacuucaagauccgcuccggcaagagcuccaucaugcggucggacgcccccaucgggaagugcaacuccgagugcaucacgcccaacggcagcauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggcggggccaggccgccgaccucaagucgacccaggcggccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgcgugcaucgggucgauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 5638 - RNA, 1701 nt, Artificial Sequence
  derived and/or modified CDS sequence (AUadapt) from InfluenzaA__ADK98920__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcaagaacugcacccugaucgacgcccugcucggggacccccagugcgacggcuuccagaacaagaagugggaccuguucguggagcgcggcaaggccuacagcaacugcuaccccuacgacgugccggacuacgcgucccugcggucgcucgucgccuccagcgggacgcuggaguucaacaacgaguccuucaacuggaccggcgugacccagaacgggaccucguccgccugcauccgccggucgaagaacuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccggccggaucaccgugucgacgaagcgcucccagcagaccgugaucccgaacaucggcagccggccccgcguccggaacauccccucgcgcaucuccaucuacuggaccaucgugaagcccggggacauccugcucaucaacagcaccggcaaccugaucgccccgcggggguacuucaagauccgcuccggcaagucguccaucaugcggucggacgcccccaucggcaagugcaacuccgagugcaucacgcccaacgggagcauccccaacgacaagccguuccagaacgugaaccgcaucaccuacggcgccugcccccgguacgucaagcaguccacccugaagcucgcgaccgggaugcgcaacgugcccgagaagcagacgcggggcaucuucggggccaucgccggcuucaucgagaacggcugggaggggaugguggacggcugguacggguuccgccaccagaacucggagggccgggggcaggccgccgaccugaaguccacccaggcggccaucgaccagaucaacggcaagcugaaccgccucaucggcaagaccaacgagaaguuccaccagaucgagaaggaguucagcgaggucgaggggcggauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 5639 - RNA, 1701 nt, Artificial Sequence; identical to SEQ ID NO: 2679
  derived and/or modified CDS sequence (AUadapt) from InfluenzaA__ADK98931__HA

SEQ ID NO: 5640 - RNA, 1701 nt, Artificial Sequence
  derived and/or modified CDS sequence (AUadapt) from InfluenzaA__ADK98942__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacaacucguucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccagcgggcggaucaccguguccacgaagcgcucgcagcagaccgugaucagcaacaucggcucccggccgcgcguccggaacauccccucgcgcaucuccaucuacuggaccaucgugaagcccggcgacauccugcucaucaacagcaccgggaaccugaucgcgccccggggcuacuucaagauccgcuccgggaaguccuccaucaugcggucggacgccccgaucggcaagugcaacuccgagugcaucacgcccaacggcagcauccccaacgacaagcccuuccagaacgugaaccgcaucaccuacggggccugcccgcgguacgucaagcagaacacccugaagcucgccaccggcaugcgcaacgugcccgagaagcagacgcgggggaucuucggcgccaucgccggguucaucgagaacggcugggagggcaugguggacgggugguacggcuuccgccaccagaacuccgaggggcggggccaggccgccgaccucaagucgacccaggcggccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgcgugcaucgggucgauccgcaacggcaccuacgaccacaacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 5641 - RNA, 1701 nt, Artificial Sequence
  derived and/or modified CDS sequence (AUadapt) from InfluenzaA__ADK98953__HA
augaagaccaucaucgcccugucguacaugcucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucaucgccagcuccggcacgcuggaguucaacaacgagucguucaacuggaccggggucacccagaacggcaccuccucggccugcauccgccgguccaacaacagcuucuucucccgccugaacuggcucacgcaccugaaguucaaguaccccgcccugaacgugaccaugcccaacaacgagcaguucgacaagcucuacaucuggggcgugcaccaccccgggaccgacaacgaccagaucuuccuguacgcgcaggccucggggcggaucaccgucuccacgaagcgcagccagcagaccgugaucccgaacaucggcucgcggccccgcgugcggaacauccccucccgcaucagcaucuacuggaccaucgucaagcccggcgacauccugcucaucaacuccaccgggaaccugaucgccccgcggggcuacuucaagauccgcucggggaaguccucgaucaugcgguccgacgcccccaucggcaagugcaacagcgagugcaucacgcccaacggcuccauccccaacgacaagccguuccagaacgugaaccgcaucaccuacggggccugcccccgguacgugaagcagaacacccugaagcucgcgaccggcaugcgcaacguccccgagaagcagacgcgggggaucuucggcgccaucgccggguucaucgagaacggcugggagggcaugguggacgggugguacggcuuccgccaccagaacucggaggggcggggccaggccgccgaccugaaguccacccaggcggccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacacgaucgaccucaccgacucggagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacguguaccgggacgaggcccucaacaaccgcuuccagaucaagggggucgagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 5642 - RNA, 1701 nt, Artificial Sequence; identical to SEQ ID NO: 2679
  derived and/or modified CDS sequence (AUadapt) from InfluenzaA__ADK98964__HA

SEQ ID NO: 5643 - RNA, 1701 nt, Artificial Sequence; identical to SEQ ID NO: 5596
  derived and/or modified CDS sequence (AUadapt) from InfluenzaA__ADK98975__HA

SEQ ID NO: 5644 - RNA, 1701 nt, Artificial Sequence; identical to SEQ ID NO: 5641
  derived and/or modified CDS sequence (AUadapt) from InfluenzaA__ADK98986__HA

SEQ ID NO: 5645 - RNA, 1701 nt, Artificial Sequence; identical to SEQ ID NO: 3858
  derived and/or modified CDS sequence (AUadapt) from InfluenzaA__ADK98997__HA

SEQ ID NO: 5646 - RNA, 1701 nt, Artificial Sequence; identical to SEQ ID NO: 5641
  derived and/or modified CDS sequence (AUadapt) from InfluenzaA__ADK99008__HA

SEQ ID NO: 5647 - RNA, 1701 nt, Artificial Sequence
  derived and/or modified CDS sequence (AUadapt) from InfluenzaA__ADK99030__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaagaacagcuucuucucccgccugaacuggcucacgcaccugaacuucaaguaccccgcccugaacgugaccaugcccaacaacgagcgguucgacaagcucuacaucuggggcguccaccaccccgggaccgacaaggaccagaucuuccuguacgcgcaggccucggggcgcaucaccguguccacgaagcggagccagcagaccgugaucccgaacaucggcucgcgcccccggguccgcaacauccccucccggaucagcaucuacuggaccaucgugaagcccggcgacauccugcucaucaacuccaccgggaaccugaucgccccgcgcggcuacuucaagauccggucggggaaguccucgaucaugcgcuccgacgcccccaucggcaagugcaacagcgagugcaucacgcccaacggcuccauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggguucaucgagaacggcugggagggcaugguggacgggugguacggcuuccggcaccagaacucggaggggcgcggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgcgagaacgccgaggacauggggaacggcugcuucaagaucuaccacaagugcgacaacgcgugcaucggguccauccggaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 5648 - RNA, 1701 nt, Artificial Sequence
  derived and/or modified CDS sequence (AUadapt) from InfluenzaA__ADK99041__HA
augaagaccaucaucgcccugucguacauccucugccugguguucgcccagaagcugcccggcaacgacaacuccaccgcgacgcucugccuggggcaccacgccgucccgaacggcaccaucgugaagaccaucgccaacgaccagaucgaggugaccaacgccacggagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggcguacuccaacugcuaccccuacgacgugccggacuacgccucgcugcggucccucgucgccagcuccggcacccuggaguucaacaacgagucguucaacuggacgggggugacccagaacggcaccuccucggccugcauccgccgguccaacaacagcuucuucucccgccugaacuggcucacccaccugaaguucaaguaccccgcgcugaacgugacgaugcccaacaacgagcaguucgacaagcucuacaucuggggcguccaccaccccgggaccgacaacgaccagaucuuccuguacgcccaggccucggggcggaucaccguguccaccaagcgcagccagcagacggugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccucgaucaugcgguccgacgcccccaucggcaagugcaacagcgagugcaucacccccaacggcuccauccccaacgacaagccguuccagaacgugaaccgcaucacguacggggcgugcccccgguacgucaagcagaacacccugaagcucgccaccggcaugcgcaacgugcccgagaagcagacccgggggaucuucggcgccaucgccggguucaucgagaacggcugggagggcaugguggacgggugguacggcuuccgccaccagaacucggaggggcggggccaggccgcggaccugaaguccacgcaggccgccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacaccaucgaccucacggacucggagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggcgugccagaaggggaacauccggugcaacaucugcaucuga

SEQ ID NO: 5649 - RNA, 1701 nt, Artificial Sequence; identical to SEQ ID NO: 5596
  derived and/or modified CDS sequence (AUadapt) from InfluenzaA__ADK99063__HA

SEQ ID NO: 5650 - RNA, 1701 nt, Artificial Sequence; identical to SEQ ID NO: 2679
  derived and/or modified CDS sequence (AUadapt) from InfluenzaA__ADK99085__HA

SEQ ID NO: 5651 - RNA, 1701 nt, Artificial Sequence; identical to SEQ ID NO: 2679
  derived and/or modified CDS sequence (AUadapt) from InfluenzaA__ADK99096__HA

SEQ ID NO: 5652 - RNA, 1701 nt, Artificial Sequence; identical to SEQ ID NO: 2679
  derived and/or modified CDS sequence (AUadapt) from InfluenzaA__ADK99107__HA

SEQ ID NO: 5653 - RNA, 1701 nt, Artificial Sequence
  derived and/or modified CDS sequence (AUadapt) from InfluenzaA__ADK99118__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacaucccccaccagauccucgacggcaagaacugcacccugaucgacgcccugcucggggacccccagugcgacggcuuccagaacaagaagugggaccuguucguggagcgcuccaaggccuacucgaacugcuaccccuacgacgugccggacuacgcgucccugcggagccucgucgccuccucgggcacgcuggaguucaacaacgaguccuucaacuggaccggggugacccagaacggcaccagcuccgccugcauccgccggucgaagaacuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugucgacgaagcgcucccagcagaccgugaucccgaacaucggcagccggccccgcguccggaacauccccucgcgcaucuccaucuacuggaccaucgugaagcccggcgacauccugcucaucaacagcaccgggaaccugaucgccccgcggggcuacuucaagauccgcuccggcaagucguccaucaugcggagcgacgcccccaucgggaagugcaacuccgagugcaucacgcccaacggcucgauccccaacgacaagccguuccagaacgugaaccgcaucaccuacggggccugcccccgguacgucaagcaguccacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagaccaacgagaaguuccaccagaucgagaaggaguucucggaggucgagggccggauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacauggggaacggcugcuucaagaucuaccacaagugcaacaacgcgugcaucggguccauccgcaacggcaccuacgaccacgacgucuaccgggacgaggcccucaacaaccgcuuccagaucaaggggguggagcucaagucgggcuacaaggacuggauccuguggaucuccuucgccaucagcugcuuccugcugugcguggcccugcucggcuucaucaugugggccugccagaaggggaacauccggugcaacaucugcaucuga

SEQ ID NO: 5654 - RNA, 1701 nt, Artificial Sequence
  derived and/or modified CDS sequence (AUadapt) from InfluenzaA__ADK99129__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaagaacucguucuucucccgccugaacuggcucacgcaccugaacuucaaguaccccgcccugaacaugaccaugcccaacaacgagcaguucgacaagcucuacaucuggggcgugcaccaccccgggaccgacaaggaccagaucuuccuguacgcgcaggccagcgggcggaucaccgucuccacgaagcgcucgcagcagaccgugaucccgaacaucggcagccggccccgcgugcggaacauccccucccgcaucucgaucuacuggaccaucgucaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacgcccaacggcuccauccccaacgacaagccguuccagaacgugaaccgcaucaccuacggggccugcccccgguacgugaagcagucgacccugaagcucgcgaccggcaugcgcaacguccccgagaagcagacgcgggggaucuucggcgccaucgccggguucaucgagaacggcugggagggcaugguggacgggugguacggcuuccgccaccagaacuccgaggggcggggccaggccgccgaccugaaguccacccaggcggccaucgaccagaucaacgggaagcugaaccgccucaucggcaagaccaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgccgaggacauggggaacggcugcuucaagaucuaccacaagugcaacaacgcgugcaucgggucgauccgcaacggcaccuacgaccacgacguguaccgggacgaggcccucaacaaccgcuuccagaucaagggggucgagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 5655 - RNA, 1701 nt, Artificial Sequence; identical to SEQ ID NO: 5596
  derived and/or modified CDS sequence (AUadapt) from InfluenzaA__ADK99140__HA

SEQ ID NO: 5656 - RNA, 1701 nt, Artificial Sequence
  derived and/or modified CDS sequence (AUadapt) from InfluenzaA__ADK99151__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcaagaacugcacccugaucgacgcccugcucggggacccccagugcgacggccugcagaacaagaagugggaccuguucguggagcgcucgaaggccuacuccaacugcuaccccuacgacgugccggacuacgcgagccuccggucccuggucgccucguccggcacgcuggaguucaacaacgagucguucaacuggaccggggugacccagaacggcaccuccagcgccugcauccgccgguccaagaacucguucuucucccgccucaacuggcugacgcaccugaacuucaaguaccccgcccucaacgugaccaugcccaacaacgagcaguucgacaagcuguacaucuggggcguccaccaccccgggaccgacaaggaccagaucuuccuguacgcgcaggccucggggcggaucaccguguccacgaagcgcagccagcagaccgccaucccgaacaucggcucgcggccccgcgugcggaacauccccucccgcaucucgaucuacuggaccaucgucaagcccggcgacauccuccugaucaacuccaccgggaaccugaucgccccgcggggcuacuucaagauccgcagcgggaaguccucgaucaugcgguccgacgcccccaucggcaagugcaacucgaagugcaucacgcccaacggcuccauccccaacgacaagccguuccagaacgugaaccgcaucaccuacggggcgugcccccgguacgugaagcagaacacccucaagcuggccaccggcaugcgcaacguccccgagaagcagacgcgggggaucuucggcgccaucgccggguucaucgagaacggcugggagggcaugguggacgggugguacggcuuccgccaccagaacagcgaggggcggggccaggccgcggaccugaaguccacccaggccgccaucgaccagaucaacgggaagcucaaccgccugaucggcaagaccaacgagaaguuccaccagaucgagaaggaguucucggagguggagggccggauccaggaccuggagaaguacgucgaggacaccaagaucgaccucugguccuacaacgccgagcugcugguggcccucgagaaccagcacacgaucgaccugaccgacucggagaugaacaagcuguucgagaagaccaagaagcagcuccgcgagaacgcggaggacauggggaacggcugcuucaagaucuaccacaagugcgacaacgccugcaucggguccauccgcaacggcaccuacgaccacgacguguaccgggacgaggcccugaacaaccgcuuccagaucaagggggucgagcugaaguccggcuacaaggacuggauccucuggaucuccuucgccaucagcugcuuccugcugugcguggcccuccugggcuucaucaugugggcgugccagaaggggaacauccggugcaacaucugcaucuga

SEQ ID NO: 5657 - RNA, 1701 nt, Artificial Sequence; identical to SEQ ID NO: 5596
  derived and/or modified CDS sequence (AUadapt) from InfluenzaA__ADK99162__HA

SEQ ID NO: 5658 - RNA, 1701 nt, Artificial Sequence
  derived and/or modified CDS sequence (AUadapt) from InfluenzaA__ADK99173__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugauccagucguccagcaccggggagaucugcgacucgccccaccagauccucgacggcgagaacugcacccugaucgacgcccugcucggggacccccagugcgacggccugcagaacaagaagugggaccuguucgucgagcgcucgaaggccuacuccaacugcuaccccuacgacgugccggacuacgcgagccuccggucccugguggccucguccggcacgcuggaguucaacaacgagagcuucaacuggaccggggucacccagaacggcaccuccucggccugcauccgccgguccaacaacucguucuucucccgccucaacuggcugacgcaccugaaguucaaguaccccgcccucaacgugaccaugcccaacaacgagcaguucgacaagcuguacaucuggggcgugcaccaccccgggaccgacaacgaccagaucuuccuguacgcgcaggccagcgggcggaucaccgucuccacgaagcgcucgcagcagaccgugaucccgaacaucggcucgcggccccgcgugcggaacauccccucccgcaucagcaucuacuggaccaucgucaagcccggcgacauccuccugaucaacuccaccgggaaccugaucgccccgcggggcuacuucaagauccgcucggggaaguccagcaucaugcgguccgacgcccccaucggcaagugcaacucggagugcaucacgcccaacggcuccauccccaacgacaagccguuccagaacgugaaccgcaucaccuacggggccugcccccgguacgugaagcagaacacccucaagcuggcgaccggcaugcgcaacguccccgagaagcagacgcgggggaucuucggcgccaucgccggguucaucgagaacggcugggagggcaugguggacgggugguacggcuuccgccaccagaacucggaggggcggggccaggccgccgaccugaaguccacccaggcggccaucgaccagaucaacgggaagcucaaccgccugaucggcaagaccaacgagaaguuccaccagaucgagaaggaguucagcgagguggagggccggauccaggaccuggagaaguacgucgaggacaccaagaucgaccucugguccuacaacgccgagcugcugguggcccucgagaaccagcacacgaucgaccugaccgacucggagaugaacaagcuguucgagaagaccaagaagcagcuccgcgagaacgccgaggacauggggaacggcugcuucaagaucuaccacaagugcgacaacgcgugcaucggguccauccgcaacggcaccuacgaccacgacguguaccgggacgaggcccugaacaaccgcuuccagaucaagggggucgagcugaaguccggcuacaaggacuggauccucuggaucuccuucgccaucagcugcuuccugcugugcguggcccuccugggcuucaucaugugggccugccagaaggggaacauccggugcaacaucugcaucuga

SEQ ID NO: 5659 - RNA, 1701 nt, Artificial Sequence
  derived and/or modified CDS sequence (AUadapt) from InfluenzaA__ADK99184__HA
augaagaccaucaucgcccugucguacauccucugccugguguccgcccagaagcugcccggcaacgacaacucgaccgcgacgcucugccuggggcaccacgccgucccgaacggcaccaucgugaagaccaucaccaacgaccagaucgaggugacgaacgccaccgagcugguccaguccagcuccaccggggagaucugcaacucgccccaccagauccucgacggcgagaacugcacccugaucgacgcccugcucggggacccccagugcgacggcuuccagaacaagaagugggaccuguucguggagcgcuccaaggccuacucgaacugcuaccccuacgacgugccggacuacgcgucccugcggagccucgucgccuccucgggcacgcuggaguucaacaacgaguccuucaacuggaccggggugacccagaacggcaccagcuccgccugcauccgccggucgaacaacuccuucuucucgcgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccuccgggcggaucaccgugagcacgaagcgcucgcagcagaccgugaucccgaacaucggcucccggccccgcguccggaacauccccucgcgcaucuccaucuacuggaccaucgugaagcccggcgacauccugcucaucaacagcaccgggaaccugaucgccccgcggggcuacuucaagauccgcuccggcaagucguccaucaugcggagcgacgcccccaucgggaagugcaacuccgagugcaucacgcccaacggcucgauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggcggggccaggccgccgaccucaagucgacccaggcggccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgcgugcaucgggucgauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 5660 - RNA, 1701 nt, Artificial Sequence; identical to SEQ ID NO: 2679
  derived and/or modified CDS sequence (AUadapt) from InfluenzaA__ADK99195__HA

SEQ ID NO: 5661 - RNA, 1701 nt, Artificial Sequence
  derived and/or modified CDS sequence (AUadapt) from InfluenzaA__ADK99206__HA
augaagaccaucaucgcccugucguacauccucugccugguguucgcccagaagcugcccggcaacgacaacuccaccgcgacgcucugccuggggcaccacgccgucccgaacggcaccguggugaagaccaucaccaacgaccagaucgaggucacgaacgccaccgagcuggugcagucguccagcaccggggagaucugcgacucgccccaccagauccucgacggcaagaacugcacccugaucgacgcccugcucggggacccccagugcgacggcuuccagaacaagaagugggaccuguucguggagcgcuccaaggccuacuccaacugcuaccccuacgacgucccggacuacgcgagccugcggucccucguggccucguccggcacgcuggaguucaacaacgagagcuucaacuggaccggggugacccagaacggcaccuccucggccugcauccgccgguccaagaacagcuucuucucccgccugaacuggcucacgcaccugaacuucaaguaccccgcccugaacgucaccaugcccaacaacgagcaguucgacaagcucuacaucuggggcgugcaccaccccgggaccgacaaggaccagaucuuccuguacgcgcaggccucggggcggaucaccguguccacgaagcgcagccagcagaccgucaucccgaacaucggcucgcggccccgcgugcggaacauccccucccgcgugagcaucuacuggaccaucgucaagcccggcgacauccugcucaucaacuccaccgggaaccugaucgccccgcggggcuacuucaagauccgcucggggaaguccagcaucaugcgguccgacgcccccaucggcaagugcaacucggagugcaucacgcccaacggcuccauccccaacgacaagccguuccagaacgugaaccgcaucaccuacggggccugcccccgguacgugaagcagaacacccugaagcucgcgaccggcaugcgcaacguccccgagaagcagacgcgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagaccaacgagaaguuccaccagaucgagaaggaguucucggagguggagggccggauccaggaccuggagaaguacgucgaggacaccaagaucgaccugugguccuacaacgccgagcuccuggugagccuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgccugcaucgggucgauccgcaacggcaccuacgaccacgacguguaccgggacgaggcgcucaacaaccgcuuccagaucaagggggucgagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 5662 - RNA, 1701 nt, Artificial Sequence; identical to SEQ ID NO: 5596
  derived and/or modified CDS sequence (AUadapt) from InfluenzaA__ADK99217__HA

SEQ ID NO: 5663 - RNA, 1701 nt, Artificial Sequence; identical to SEQ ID NO: 5596
  derived and/or modified CDS sequence (AUadapt) from InfluenzaA__ADK99228__HA

SEQ ID NO: 5664 - RNA, 1701 nt, Artificial Sequence
  derived and/or modified CDS sequence (AUadapt) from InfluenzaA__ADK99239__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaagaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccucggggcggaucaccguguccacgaagcgcagccagcagaccgugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggcggggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 5665 - RNA, 1701 nt, Artificial Sequence
  derived and/or modified CDS sequence (AUadapt) from InfluenzaA__ADK99250__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcuccaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacucguucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccagcgggcggaucaccguguccacgaagcgcucgcagcagaccgugaucccgaacaucggcagccggccccgcguccggaacauccccucccgcaucucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacucggagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagaccaacgagaaguuccaccagaucgagaaggaguucucggaggucgagggccggauccaggacaucgagaaguacguggaggacaccaagaucgaccugugguccuacaacgccgagcugcucguggcccuggagaaccagcacacgaucgaccugaccgacagcgagaugaacaagcuguucgagaagaccaagaagcagcuccgcgagaacgccgaggacauggggaacggcugcuucaagaucuaccacaagugcgacaacgcgugcaucggguccauccgcaacggcaccuacgaccacgacgucuaccgggacgaggcccugaacaaccgcuuccagaucaaggggguggagcucaagucgggcuacaaggacuggauccuguggaucuccuucgccaucagcugcuuccugcucugcguggcccugcugggcuucaucaugugggccugccagaaggggaacauccggugcaacaucugcaucuga

SEQ ID NO: 5666 - RNA, 1701 nt, Artificial Sequence; identical to SEQ ID NO: 5596
  derived and/or modified CDS sequence (AUadapt) from InfluenzaA__ADK99261__HA

SEQ ID NO: 5667 - RNA, 1701 nt, Artificial Sequence
  derived and/or modified CDS sequence (AUadapt) from InfluenzaA__ADK99283__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaagaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccucggggcggaucaccguguccacgaagcgcagccagcagaccgugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggcggggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagcgcuacguggaggacaccaagaucgaccugugguccuacaacgccgagcuccugguggcccuggagaaccagcacacgaucgaccucaccgacucggagaugaacaagcuguucgagaagaccaagaagcagcugcgcgagaacgccgaggacauggggaacggcugcuucaagaucuaccacaagugcgacaacgcgugcaucggguccauccggaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 5668 - RNA, 1701 nt, Artificial Sequence
  derived and/or modified CDS sequence (AUadapt) from InfluenzaA__ADK99294__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccaggacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccucggggcggaucaccguguccacgaagcgcagccagcaggccgugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccucgaucaugcgguccgacgcccccaucggcaagugcaacagcgagugcaucacccccaacggcuccauccccaacgacaagccguuccagaacgugaaccgcaucacguacggggcgugcccccgguacgucaagcagaacacccugaagcucgccaccggcaugcgcaacgugcccgagaagcagacccgggggaucuucggcgccaucgccggguucaucgagaacggcugggagggcaugguggacgggugguacggcuuccgccaccagaacucggaggggcggggccaggccgcggaccugaaguccacgcaggccgccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacaccaucgaccucacggacucggagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggcgugccagaaggggaacauccggugcaacaucugcaucuga

SEQ ID NO: 5669 - RNA, 1701 nt, Artificial Sequence; identical to SEQ ID NO: 2679
  derived and/or modified CDS sequence (AUadapt) from InfluenzaA__ADK99305__HA

SEQ ID NO: 5670 - RNA, 1701 nt, Artificial Sequence; identical to SEQ ID NO: 2679
  derived and/or modified CDS sequence (AUadapt) from InfluenzaA__ADL27989__HA

SEQ ID NO: 5671 - RNA, 1701 nt, Artificial Sequence
  derived and/or modified CDS sequence (AUadapt) from InfluenzaA__ADL28000__HA
augaagaccaucaucgcccugucguacauccucugccugguguucgcccagaagcugcccggcaacgacaacuccaccgcgacgcucugccuggggcaccacgccgucccgaacggcaccauggugaagaccaucaccaacgaccagaucgaggugacgaacgccaccgagcugguccagucguccagcaccggggagaucugcgacucgccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaagaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgagcggaucaccguguccacgaagcgcucgcagcagaccgugaucccgaacaucgggagccggccccgcguccggaacauccccucccgcaucucgaucuacuggaccaucgugaagcccggcgacauccugcucaucaacuccaccggcaaccugaucgccccgcggggguacuucaagauccgcagcggcaaguccucgaucaugcgguccgacgcccccaucgggaagugcaacagcgagugcaucacgcccaacggcuccauccccaacgacaagccguuccagaacgugaaccgcaucaccuacggcgccugcccccgguacgucaagcagucgacccugaagcucgcgaccgggaugcgcaacgugcccgagaagcagacgcggggcaucuucggggccaucgccggcuucaucgagaacgggugggagggcaugguggacggcugguacggguuccgccaccagaacuccgagggccgggggcaggccgccgaccugaaguccacccaggcggccaucgaccagaucaacggcaagcugaaccgccucaucgggaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgccgaggacaugggcaacgggugcuucaagaucuaccacaagugcgacaacgcgugcaucggcucgauccgcaacgggaccuacgaccacgacgucuaccgggacgaggcccucaacaaccgcuuccagaucaagggcguggagcugaaguccggguacaaggacuggauccuguggaucagcuucgccaucuccugcuuccuccugugcguggcccugcucggcuucaucaugugggccugccagaagggcaacauccggugcaacaucugcaucuga

SEQ ID NO: 5672 - RNA, 1701 nt, Artificial Sequence
  derived and/or modified CDS sequence (AUadapt) from InfluenzaA__ADL28011__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccucggggcggaucaccguguccacgcgccggagccagcagaccgugaucccgaacaucggcucgcgcccccggguccgcaacauccccucccggaucagcaucuacuggaccaucgugaagcccggcgacauccugcucaucaacuccaccgggaaccugaucgccccgcgcggcuacuucaagauccggucggggaaguccucgaucaugcgcuccgacgcccccaucggcaagugcaacagcgagugcaucacgcccaacggcuccauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggguucaucgagaacggcugggagggcaugguggacgggugguacggcuuccggcaccagaacucggaggggcgcggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgcgagaacgccgaggacauggggaacggcugcuucaagaucuaccacaagugcgacaacgcgugcaucggguccauccggaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 5673 - RNA, 1701 nt, Artificial Sequence; identical to SEQ ID NO: 5596
  derived and/or modified CDS sequence (AUadapt) from InfluenzaA__ADL28022__HA

SEQ ID NO: 5674 - RNA, 1701 nt, Artificial Sequence; identical to SEQ ID NO: 2679
  derived and/or modified CDS sequence (AUadapt) from InfluenzaA__ADL28033__HA

SEQ ID NO: 5675 - RNA, 1701 nt, Artificial Sequence; identical to SEQ ID NO: 3858
  derived and/or modified CDS sequence (AUadapt) from InfluenzaA__ADL28044__HA

SEQ ID NO: 5676 - RNA, 1701 nt, Artificial Sequence
  derived and/or modified CDS sequence (AUadapt) from InfluenzaA__ADL28055__HA
augaagaccaucguggcccugucguacauccucugccuggucuucgcccagaagcugcccggcaacgacaacuccaccgcgacgcucugccuggggcaccacgccgugccgaacggcaccaucgugaagaccaucaccaacgaccagaucgaggucacgaacgccaccgagcuggugcagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgucccggacuacgcgucgcugcggucccucguggccagcuccggcacgcuggaguucaacaacgagucguucaacuggaccggggugacccagaacggcaccuccucggccugcauccgccgguccaacaacagcuucuucucccgccugaacuggcucacgcaccugaaguucaaguaccccgcccugaacgucaccaugcccaacaacgagcaguucgacaagcucuacaucuggggcgugcaccaccccgggaccgacaacgaccagaucuuccuguacgcgcaggccucggggcggaucaccguguccacgaagcgcagccagcagaccgucaucccgaacaucggcucgcggccccgcgugcggaacauccccucccgcaucagcaucuacuggaccaucgugaagcccggcgacauccugcucaucaacuccaccgggaaccugaucgccccgcggggcuacuucaagauccgcucggggaaguccucgaucaugcgguccgacgcccccaucggcaagugcaacagcgagugcaucacgcccaacggcuccauccccaacgacaagccguuccagaacgucaaccgcaucaccuacggggccugcccccgguacgugaagcagaacacccugaagcucgcgaccggcaugcgcaacgugcccgagaagcagacgcgggggaucuucggcgccaucgccggguucaucgagaacggcugggagggcauggucgacgggugguacggcuuccgccaccagaacucggaggggcggggccaggccgccgaccugaaguccacccaggcggccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcccuggagaaccagcacacgaucgaccucaccgacucggagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcccugcucggcuucaucaugugggccugccagaaggggaacauccggugcaacaucugcaucuga

SEQ ID NO: 5677 - RNA, 1701 nt, Artificial Sequence; identical to SEQ ID NO: 2679
  derived and/or modified CDS sequence (AUadapt) from InfluenzaA__ADL28066__HA

SEQ ID NO: 5678 - RNA, 1701 nt, Artificial Sequence; identical to SEQ ID NO: 5596
  derived and/or modified CDS sequence (AUadapt) from InfluenzaA__ADL28077__HA

SEQ ID NO: 5679 - RNA, 1701 nt, Artificial Sequence
  derived and/or modified CDS sequence (AUadapt) from InfluenzaA__ADL28088__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacaacucguucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacagccaggcguccgggcggaucaccgugucgacgaagcgcagccagcagaccgugaucccgaacaucggcucccggccccgcguccggaacauccccucgcgcaucuccaucuacuggaccaucgugaagcccggcgacauccugcucaucaacagcaccgggaaccugaucgccccgcggggcuacuucaagauccgcuccgggaaguccuccaucaugcggucggacgcccccaucggcaagugcaacuccgagugcaucacgcccaacggcagcauccccaacgacaagccguuccagaacgugaaccgcaucaccuacggggccugcccccgguacgucaagcagaacacccugaagcucgccaccggcaugcgcaacgugcccgagaagcagacgcgggggaucuucggcgcgaucgccggguucaucgagaacggcugggagggcaugguggacgggugguacggcuuccgccaccagaacuccgaggggcggggccaggccgccgaccucaagucgacccaggccgcgaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgccugcaucgggucgauccgcaacggcaccuacgaccacgacgucuaccgggacgaggcgcucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 5680 - RNA, 1701 nt, Artificial Sequence; identical to SEQ ID NO: 2679
  derived and/or modified CDS sequence (AUadapt) from InfluenzaA__ADL28099__HA

SEQ ID NO: 5681 - RNA, 1701 nt, Artificial Sequence
  derived and/or modified CDS sequence (AUadapt) from InfluenzaA__ADL28110__HA
augaagaccaucaucgcccugucguacauccucugccugguguucgcccagaagcugcccggcaacgacaacuccaccgcgacgcucugcaucgggcaccacgccgucccgaacggcaccaucgugaagaccaucaccaacgaccagaucgaggugacgaacgccaccgagcugguccagaacucguccaccggggagaucugcgacagcccccaccagauccuggacggcaagaacugcacccucaucgacgcccugcugggggacccccagugcgacggcuuccagaacaagaagugggaccucuucguggagcgcuccaaggccuacucgaacugcuaccccuacgacgugccggacuacgcgucccugcggucgcuggucgccuccagcggcacgcucgaguucaacaacgaguccuucaacuggaccggggugacccagaacggcaccucguccgccugcauccgccggucgaagaacuccuucuucagccgccugaacuggcugacgcaccucaacuucaaguaccccgcccugaacgugaccaugcccaacaacgagcaguucgacaagcuguacaucuggggcguccaccaccccgggaccgacaaggaccagaucuuccucuacgcgcaggccuccgggcggaucaccgugucgacgaagcgcucccagcagaccgccaucccgaacaucggcucgcggccccgcgugcggaacauccccagccgcaucuccaucuacuggaccaucgucaagcccggcgacauccugcugaucaacucgaccgggaaccucaucgccccgcggggcuacuucaagauccgcuccggcaagucguccaucaugcggagcgacgcccccaucgacaagugcaacuccgagugcaucacgcccaacgggucgauccccaacgacaagccguuccagaacgugaaccgcaucaccuacggcgcgugcccccgguacgugaagcagaacacccugaagcuggccaccgggaugcgcaacguccccgagaagcagacgcggggcaucuucggggccaucgccggcuucaucgagaacgggugggagggcaugguggacggcugguacggguuccgccaccagaacuccgagggccgggggcaggccgcggaccucaagucgacccaggccgccaucgaccagaucaacggcaagcugaaccgccugaucgggaagaccaacgagaaguuccaccagaucgagaaggaguucuccgagguggagggccggauccaggaccucgagaaguacgucgaggacaccaagaucgaccuguggagcuacaacgccgagcugcucguggcccuggagaaccagcacacgaucgaccugaccgacuccgagaugaacaagcuguucgagaagaccaagaagcagcuccgcgagaacgcggaggacaugggcaacgggugcuucaagaucuaccacaagugcgacaacgccugcaucggcucgauccgcaacgggaccuacgaccacgacguguaccgggacgaggcccugaacaaccgcuuccagaucaagggcgucgagcucaaguccggguacaaggacuggauccuguggaucagcuucgccaucuccugcuuccugcucugcguggcccugcugggcuucaucaugugggcgugccagaagggcaacauccggugcaacaucugcaucuga

SEQ ID NO: 5682 - RNA, 1701 nt, Artificial Sequence
  derived and/or modified CDS sequence (AUadapt) from InfluenzaA__ADL28126__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugaaccagaacggcaccuccucggccugcauccgccgguccaacaacagcuucuucucccgccugaacuggcucacccaccugaaguucaaguaccccgcccugaacgugacgaugcccaacaacgagcaguucgacaagcucuacaucuggggcguccaccaccccgggaccgacaacgaccagaucuuccuguacgcgcaggccucggggcggaucaccguguccaccaagcgcagccagcagacggugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccucgaucaugcgguccgacgcccccaucggcaagugcaacagcgagugcaucacccccaacggcuccauccccaacgacaagccguuccagaacgugaaccgcaucacguacggggccugcccccgguacgucaagcagaacacccugaagcucgcgaccggcaugcgcaacgugcccgagaagcagacccgggggaucuucggcgccaucgccggguucaucgagaacggcugggagggcaugguggacgggugguacggcuuccgccaccagaacucggaggggcggggccaggccgccgaccugaaguccacgcaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacaccaucgaccucacggacucggagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 5683 - RNA, 1701 nt, Artificial Sequence
  derived and/or modified CDS sequence (AUadapt) from InfluenzaA__ADL28137__HA
augaagaccaucaucgcccugucguacauccucugccugguguccgcccagaagcugcccggcaacgacaacucgaccgcgacgcucugccuggggcaccacgccgucccgaacggcaccaucgugaagaccaucaccaacgaccagaucgaggugacgaacgccaccgagcugguccaguccagcuccaccggggagaucugcgacggcccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgucgcugcggucccucgucgccagcuccgggacgcuggaguucaacaacgagucguucaacuggaccggcgugacccagaacgggaccuccucggccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccucgggccggaucaccguguccacgaagcgcucgcagcagaccgugaucccgaacaucggcagccggccccgcguccggaacauccccucccgcaucucgaucuacuggaccaucgugaagcccggggacauccugcucaucaacuccaccggcaaccugaucgccccgcggggguacuucaagauccgcucgggcaaguccagcaucaugcgguccgacgcccccaucggcaagugcaacucggagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacucggagggccgggggcaggccgccgaccugaaguccacccaggcggccaucgaccagaucaacggcaagcugaaccgccucaucggcaagaccaacgagaaguuccaccagaucgagaaggaguucagcgaggucgaggggcggauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcucaagucgggcuacaaggacuggauccuguggaucuccuucgccaucagcugcuuccugcugugcguggcccugcucggguucaucaugugggccugccagaagggcaacauccggugcaacaucugcaucuga

SEQ ID NO: 5684 - RNA, 1701 nt, Artificial Sequence; identical to SEQ ID NO: 2679
  derived and/or modified CDS sequence (AUadapt) from InfluenzaA__ADL28148__HA

SEQ ID NO: 5685 - RNA, 1701 nt, Artificial Sequence; identical to SEQ ID NO: 5596
  derived and/or modified CDS sequence (AUadapt) from InfluenzaA__ADL28170__HA

SEQ ID NO: 5686 - RNA, 1701 nt, Artificial Sequence; identical to SEQ ID NO: 2679
  derived and/or modified CDS sequence (AUadapt) from InfluenzaA__ADL28181__HA

SEQ ID NO: 5687 - RNA, 1701 nt, Artificial Sequence; identical to SEQ ID NO: 5591
  derived and/or modified CDS sequence (AUadapt) from InfluenzaA__ADL28192__HA

SEQ ID NO: 5688 - RNA, 1701 nt, Artificial Sequence; identical to SEQ ID NO: 5597
  derived and/or modified CDS sequence (AUadapt) from InfluenzaA__ADL28203__HA

SEQ ID NO: 5689 - RNA, 1701 nt, Artificial Sequence; identical to SEQ ID NO: 3656
  derived and/or modified CDS sequence (AUadapt) from InfluenzaA__ADL28214__HA

SEQ ID NO: 5690 - RNA, 1701 nt, Artificial Sequence
  derived and/or modified CDS sequence (AUadapt) from InfluenzaA__ADL28225__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacucgcaggcguccgggcggaucaccgugagcacgaagcgcucgcagcagaccgugaucccgaacaucggcucccggccccgcguccggaacauccccagccgcaucuccaucuacuggaccaucgugaagcccggcgacauccugcucaucaacucgaccgggaaccugaucgccccgcggggcuacuucaagauccgcuccgggaaguccuccaucaugcggucggacgcccccaucggcaagugcaacuccgagugcaucacgcccaacggcagcauccccaacgacaagccguuccagaacgugaaccgcaucaccuacggggccugcccccgguacgucaagcagaacacccugaagcucgccaccggcaugcgcaacgugcccgagaagcagacgcgggggaucuucggcgcgaucgccggguucaucgagaacggcugggagggcaugguggacgggugguacggcuuccgccaccagaacuccgaggggcggggccaggccgccgaccucaagucgacccaggccgcgaucgaccagaucaacgggaagcugaaccgccugaucggcaagaccaacgagaaguuccaccagaucgagaaggaguucuccgaggucgagggccggauccaggaccuggagaaguacguggaggacaccaagacggaccuguggagcuacaacgccgagcuccugguggcccuggagaaccagcacaccaucgaccucaccgacuccgagaugaacaagcuguucgagaagaccaagaagcagcugcgcgagaacgccgaggacauggggaacggcugcuucaagaucuaccacaagugcgacaacgccugcaucgggucgauccgcaacggcacguacgaccacgacgucuaccgggacgaggcgcucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 5691 - RNA, 1701 nt, Artificial Sequence; identical to SEQ ID NO: 5596
  derived and/or modified CDS sequence (AUadapt) from InfluenzaA__ADL28236__HA

SEQ ID NO: 5692 - RNA, 1701 nt, Artificial Sequence; identical to SEQ ID NO: 2679
  derived and/or modified CDS sequence (AUadapt) from InfluenzaA__ADL28247__HA

SEQ ID NO: 5693 - RNA, 1701 nt, Artificial Sequence; identical to SEQ ID NO: 5609
  derived and/or modified CDS sequence (AUadapt) from InfluenzaA__ADL28258__HA

SEQ ID NO: 5694 - RNA, 1701 nt, Artificial Sequence; identical to SEQ ID NO: 2679
  derived and/or modified CDS sequence (AUadapt) from InfluenzaA__ADL28370__HA

SEQ ID NO: 5695 - RNA, 1701 nt, Artificial Sequence; identical to SEQ ID NO: 116
  derived and/or modified CDS sequence (AUadapt) from InfluenzaA__ADL29672__HA

SEQ ID NO: 5696 - RNA, 1701 nt, Artificial Sequence; identical to SEQ ID NO: 3156
  derived and/or modified CDS sequence (AUadapt) from InfluenzaA__ADL29682__HA

SEQ ID NO: 5697 - RNA, 1701 nt, Artificial Sequence; identical to SEQ ID NO: 116
  derived and/or modified CDS sequence (AUadapt) from InfluenzaA__ADL29692__HA

SEQ ID NO: 5698 - RNA, 1701 nt, Artificial Sequence
  derived and/or modified CDS sequence (AUadapt) from InfluenzaA__ADL29702__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagucgcuguaccagaacgccgacacguacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucucggacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagucgcgggggcuguucggcgcgaucgccggguucaucgagggcggcuggaccgggaugguggacggcugguacggguaccaccaccagaacgagcagggcuccggguacgccgccgaccucaagagcacccagaacgccaucgacgagaucaccaacaaggugaacuccgucaucgagaagaugaacacgcaguucaccgcggugggcaaggaguucaaccaccuggagaagcgcaucgagaaccugaacaagaagaucgacgacggcuuccucgacaucuggaccuacaacgccgagcugcugguccuccuggagaacgagcggacccuggacuaccacgacucgaacgugaagaaccucuacgagaaggugcgcaaccagcugaagaacaacgccaaggagaucgggaacggcugcuucgaguucuaccacaagugcgacaacacgugcauggaguccgucaagaacgggaccuacgacuaccccaaguacagcgaggaggccaagcugaaccgggaggagaucgacggcgugaagcucgaguccacccgcaucuaccagauccuggccaucuacucgaccguggcguccagccugguccucguggugucgcugggggccaucuccuucuggaugugcagcaacggcucccugcagugccggaucugcaucuga

SEQ ID NO: 5699 - RNA, 1701 nt, Artificial Sequence; identical to SEQ ID NO: 116
  derived and/or modified CDS sequence (AUadapt) from InfluenzaA__ADL29730__HA

SEQ ID NO: 5700 - RNA, 1701 nt, Artificial Sequence; identical to SEQ ID NO: 116
  derived and/or modified CDS sequence (AUadapt) from InfluenzaA__ADL29740__HA

SEQ ID NO: 5701 - RNA, 1701 nt, Artificial Sequence; identical to SEQ ID NO: 116
  derived and/or modified CDS sequence (AUadapt) from InfluenzaA__ADL29750__HA

SEQ ID NO: 5702 - RNA, 1701 nt, Artificial Sequence
  derived and/or modified CDS sequence (AUadapt) from InfluenzaA__ADL29760__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaguacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgacccgcaucuaccagauccuggcgaucuacuccaccgucgccagcucgcuggugcucguggucucccugggggccaucagcuucuggaugugcuccaacggcagccugcagugccggaucugcaucuga

SEQ ID NO: 5703 - RNA, 1701 nt, Artificial Sequence; identical to SEQ ID NO: 116
  derived and/or modified CDS sequence (AUadapt) from InfluenzaA__ADL29770__HA

SEQ ID NO: 5704 - RNA, 1701 nt, Artificial Sequence; identical to SEQ ID NO: 4414
  derived and/or modified CDS sequence (AUadapt) from InfluenzaA__ADL29780__HA

SEQ ID NO: 5705 - RNA, 1701 nt, Artificial Sequence
  derived and/or modified CDS sequence (AUadapt) from InfluenzaA__ADL29879__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacuccuacguguucgugggcacgagcaaguacuccaagaaguucaagcccgagaucgccauccggccgaagguccgcgaccaggagggccggaugaacuacuacuggacccugguggagcccggggacaagaucaccuucgaggccaccggcaaccucguggucccccgcuacgcguucgccauggagcggaacgccgggucgggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcgccucgccaccggccugcggaacgucccgucgauccagucccgcgggcuguucggcgcgaucgccggguucaucgagggcggcuggacggggaugguggacggcugguacggguaccaccaccagaacgagcagggcagcggguacgccgccgaccucaaguccacccagaacgccaucgacgagaucaccaacaaggugaacucggucaucgagaagaugaacacccaguucacggcggugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgcgaggagaucgacggcgugaagcucgaguccacccggaucuaccagauccuggccaucuacagcaccgucgcgucgucccuggugcucguggucagccugggggccaucuccuucuggaugugcagcaacggcucccugcagugccgcaucugcaucuga

SEQ ID NO: 5706 - RNA, 1701 nt, Artificial Sequence
  derived and/or modified CDS sequence (AUadapt) from InfluenzaA__ADL32017__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugccagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacacguacguguucgugggcaccucccgguacucgaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacgagaucaccaacaaggugaacuccgucaucgagaagaugaacacgcaguucaccgcggugggcaaggaguucaaccaccuggagaagcgcaucgagaaccugaacaagaagaucgacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggccaucuacuccaccguggcgucgagccugguccucguggugucccugggggccaucucguucuggaugugcuccaacggcagccugcagugccggaucugcaucuga

SEQ ID NO: 5707 - RNA, 1701 nt, Artificial Sequence
  derived and/or modified CDS sequence (AUadapt) from InfluenzaA__ADL32037__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccguggaccagcagucgcuguaccagaacgccgacgccuacguguucgucggcacgucccgguacagcaagaaguucaagcccgagaucgccauccgcccgaaggugcgggaccaggagggccgcaugaacuacuacuggacccugguggagcccggggacaagaucaccuucgaggccaccggcaaccucgucgugccccgguacgcguucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgccaccggccugcgcaacgugccguccauccagucgcgggggcuguucggcgcgaucgccggguucaucgagggcggcuggacggggaugguggacggcugguacggguaccaccaccagaacgagcagggcuccggguacgccgccgaccucaagagcacccagaacgccaucgacgagaucaccaacaaggucaacuccgugaucgagaagaugaacacccaguucacggcggucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacucgaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagucgacccgcaucuaccagauccuggccaucuacuccaccguggcgagcucgcuggugcucgucgugucccugggggccaucagcuucuggaugugcuccaacggcagccugcagugccggaucugcaucuga

SEQ ID NO: 5708 - RNA, 1701 nt, Artificial Sequence; identical to SEQ ID NO: 116
  derived and/or modified CDS sequence (AUadapt) from InfluenzaA__ADL32047__HA

SEQ ID NO: 5709 - RNA, 1701 nt, Artificial Sequence
  derived and/or modified CDS sequence (AUadapt) from InfluenzaA__ADL32057__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagggccuguaccagaacgccgacgccuacguguucgugggcacgucgcgguacuccaagaaguucaagcccgagaucgccauccgcccgaagguccgggaccaggaggggcgcaugaacuacuacuggacccugguggagcccggcgacaagaucaccuucgaggcgaccgggaaccucguggucccccgguacgccuucgccauggagcgcaacgccggcucgggcaucaucaucuccgacacgcccgugcacgacugcaacacgaccugccagaccccgaagggggccaucaacaccagccugcccuuccagaacauccaccccaucaccaucggcaagugccccaaguacgugaaggggaccaagcugcggcucgcgaccggccugcgcaacgucccguccauccagucgcgggggcuguucggcgccaucgccggcuucaucgagggcggguggacggggaugguggacggcugguacggguaccaccaccagaacgagcagggcuccggcuacgccgccgaccucaagagcacccagaacgcgaucgacgagaucaccaacaaggugaacuccgucaucgagaagaugaacacccaguucacggccguggggaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgucccuggugcucguggucagccugggcgccaucucguucuggaugugcuccaacgggagccugcagugccggaucugcaucuga

SEQ ID NO: 5710 - RNA, 1701 nt, Artificial Sequence; identical to SEQ ID NO: 116
  derived and/or modified CDS sequence (AUadapt) from InfluenzaA__ADL32090__HA

SEQ ID NO: 5711 - RNA, 1701 nt, Artificial Sequence; identical to SEQ ID NO: 116
  derived and/or modified CDS sequence (AUadapt) from InfluenzaA__ADL32114__HA

SEQ ID NO: 5712 - RNA, 1701 nt, Artificial Sequence; identical to SEQ ID NO: 116
  derived and/or modified CDS sequence (AUadapt) from InfluenzaA__ADL32344__HA

SEQ ID NO: 5713 - RNA, 1701 nt, Artificial Sequence; identical to SEQ ID NO: 3361
  derived and/or modified CDS sequence (AUadapt) from InfluenzaA__ADL32354__HA

SEQ ID NO: 5714 - RNA, 1701 nt, Artificial Sequence
  derived and/or modified CDS sequence (AUadapt) from InfluenzaA__ADL32364__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgaucucgugguccuacaucguggagaccagcuccucggacaacggcacgugcuaccccggcgacuucaucgacuacgaggagcuccgggagcagcuguccagcguguccucguucgagcgcuucgagaucuuccccaagaccuccagcuggcccaaccacgacuccaacaagggggucaccgccgccugcccgcacgccggcgccaagucguucuacaagaaccugaucuggcucgugaagaaggggaacuccuaccccaagcugagcaaguccuacaucaacgacaagggcaaggaggugcugguccucugggggauccaccaccccucgaccagcgccgaccagcagucccuguaccagaacgccgacacguacguguucgugggcaccucgcgguacuccaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccgggagcggcaucaucaucuccgacacccccgugcacgacugcaacacgaccugccagaccccgaagggcgccaucaacaccucgcugcccuuccagaacauccaccccaucaccaucgggaagugccccaaguacgugaaguccaccaagcugcggcucgccacgggccugcgcaacgucccgagcauccagucccgggggcuguucggcgcgaucgccggguucaucgagggcggcuggaccgggaugguggacggcugguacggguaccaccaccagaacgagcagggcucgggguacgccgccgaccucaaguccacccagaacgccaucgacgagaucaccaacaaggugaacagcgucaucgagaagaugaacacgcaguucaccgcggugggcaaggaguucaaccaccuggagaagcgcaucgagaaccugaacaagaagaucgacgacggcuuccucgacaucuggaccuacaacgccgagcugcugguccuccuggagaacgagcggacccuggacuaccacgacuccaacgugaagaaccucuacgagaaggugcgcucgcagcugaagaacaacgccaaggagaucgggaacggcugcuucgaguucuaccacaagugcgacaacacgugcauggaguccgucaagaacgggaccuacgacuaccccaaguacagcgaggaggccaagcugaaccgggaggagaucgacggcgugaagcucgaguccacccgcaucuaccagauccuggccaucuacucgaccguggcguccagccugguccucguggugucgcugggggccaucuccuucuggaugugcagcaacggcucccugcagugccggaucugcaucuga

SEQ ID NO: 5715 - RNA, 1701 nt, Artificial Sequence; identical to SEQ ID NO: 116
  derived and/or modified CDS sequence (AUadapt) from InfluenzaA__ADL32374__HA

SEQ ID NO: 5716 - RNA, 1701 nt, Artificial Sequence
  derived and/or modified CDS sequence (AUadapt) from InfluenzaA__ADL32384__HA
augaaggccauccuggugguccuccuguacaccuucgccaccgcgacggccgacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagacguccagcuccgacaacgggaccugcuaccccggcgacuucaucgacuacgaggagcuccgggagcagcugucguccgugagcuccuucgagcgcuucgagaucuuccccaagaccucguccuggcccaaccacgacagcaacaagggcgucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgacguccgccgaccagcagagccuguaccagaacgccgacgccuacguguucgugggcaccucccgguacucgaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcggcucgcgacgggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagucgacccagaacgcgaucgacgagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 5717 - RNA, 1701 nt, Artificial Sequence
  derived and/or modified CDS sequence (AUadapt) from InfluenzaA__ADL32394__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagcuucuccaccaccucguccuggagcuacaucguggagacguccucguccgacaacgggaccugcuaccccggcgacuucaucgacuacgaggagcugcgggagcagcucagcuccgugucguccuucgagcgcuucgagaucuuccccaagaccagcuccuggcccaaccacgacucgaacaagggcgucaccgccgccugcccgcacgccggcgccaaguccuucuacaagaaccugaucuggcuggugaagaaggggaacagcuaccccaagcucuccaagucguacaucaacgacaagggcaaggaggugcugguccugugggggauccaccaccccagcacguccgcggaccagcagucgcucuaccagaacgccgacaccuacguguucgugggcaccucccgguacagcaagaaguucaagcccgagaucgccauccgcccgaagguccgggaccaggagggccgcaugaacuacuacuggacccugguggagcccggggacaagaucacguucgaggccaccggcaaccugguggucccccgguacgccuucgcgauggagcgcaacgccggguccggcaucaucaucucggacacccccgugcacgacugcaacaccacgugccagaccccgaagggcgccaucaacaccucccuccccuuccagaacauccaccccaucaccaucgggaagugccccaaguacgucaagagcacgaagcugcggcuggccaccggccuccgcaacgugccguccauccagucgcgggggcuguucggcgccaucgcgggguucaucgagggcggcuggaccgggaugguggacggcugguacggguaccaccaccagaacgagcagggcuccggguacgccgccgaccucaagagcacccagaacgccaucgacgagaucacgaacaaggugaacuccgucaucgagaagaugaacacccaguucaccgccgugggcaaggaguucaaccaccuggagaagcgcaucgagaaccugaacaagaagaucgacgacggcuuccuggacaucuggaccuacaacgcggagcuccugguccugcucgagaacgagcggacgcuggacuaccacgacucgaacgugaagaaccuguacgagaaggugcgcucccagcucaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcuggagucgacccgcaucuaccagauccucgccaucuacuccaccguggccagcucgcugguccugguggugucccucggggcgaucagcuucuggaugugcuccaacggcagccugcagugccggaucugcaucuga

SEQ ID NO: 5718 - RNA, 1701 nt, Artificial Sequence; identical to SEQ ID NO: 116
  derived and/or modified CDS sequence (AUadapt) from InfluenzaA__ADL32404__HA

SEQ ID NO: 5719 - RNA, 1701 nt, Artificial Sequence
  derived and/or modified CDS sequence (AUadapt) from InfluenzaA__ADL32414__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggcgcaggagggccgcaugaacuacuacuggacccugguggagcccggggacaagaucaccuucgaggccaccggcaaccucguggucccccgguacgccuucgccauggagcgcaacgccggguccggcaucaucaucagcgacacgcccgugcacgacugcaacacgaccugccagaccccgaagggcgcgaucaacaccucccugcccuuccagaacauccaccccaucaccaucgggaagugccccaaguacgucaagucgaccaagcugcggcucgccaccggccugcgcaacgugccguccauccagagccgggggcuguucggcgccaucgccggguucaucgagggcggcuggacggggaugguggacggcugguacggguaccaccaccagaacgagcagggcuccggguacgccgcggaccucaagucgacccagcacgccaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggcgaagcugaaccgggaggagaucgacggcgugaagcucgagagcacccgcaucuaccagauccuggccaucuacuccaccgucgccucgagccuggugcucguggucucccugggggccaucucguucuggaugugcuccaacggcagccugcagugccggaucugcaucuga

SEQ ID NO: 5720 - RNA, 1701 nt, Artificial Sequence
  derived and/or modified CDS sequence (AUadapt) from InfluenzaA__ADL32424__HA
augaaggccauccuggugguccuccuguacaccuucgccaucgcgaacgccgacacccugugcaucggcuaccacgccaacaacucgacggacaccguggacaccgugcucgagaagaacgucaccgugacgcacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacgggaccugcuaccccggcgacuucaucgacuacgaggagcuccgggagcagcugucguccgugagcuccuucgagcgcuucgagaucuuccccaagacgucguccuggcccaaccacgacagcaacaagggcgucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcaccucccgguacucgaagaaguucaagcccgagaucgccauccgcccgaagguccgggaccaggagggccgcaugaacuaccacuggacgcugguggagcccggggacaagaucaccuucgaggcgaccggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucacgaucgggaagugccccaaguacgucaagucgaccaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagucgacgcagcacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucaacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 5721 - RNA, 1701 nt, Artificial Sequence
  derived and/or modified CDS sequence (AUadapt) from InfluenzaA__ADL32434__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccauccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggauccugguggagcccggggacaagaucaccuucgaggcgaccggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucacgaucgggaagugccccaaguacgucaagucgaccaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacgcagcacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgacccgcaucuaccagauccuggcgaucuacuccaccgucgccagcucgcuggugcucguggucucccugggggccaucagcuucuggaugugcuccaacggcagccugcagugccggaucugcaucuga

SEQ ID NO: 5722 - RNA, 1701 nt, Artificial Sequence; identical to SEQ ID NO: 4334
  derived and/or modified CDS sequence (AUadapt) from InfluenzaA__ADL32444__HA

SEQ ID NO: 5723 - RNA, 1701 nt, Artificial Sequence
  derived and/or modified CDS sequence (AUadapt) from InfluenzaA__ADL32454__HA
auggaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccacaacauccaccccaucacgaucgggaagugccccaaguacgugaaguccaccaagcugcggcucgcgaccggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagcuggggaacggcugcuucgaguucuaccacaagugcgacaacacgugcauggaguccgugaagaacgggaccuacgacuaccccaaguacucggaggaggccaagcucaaccgggaggagaucgacggcgugaagcuggaguccacccgcaucuaccagauccuggcgaucuacagcaccgucgccucgucccucgugcugguggucagccugggggccaucuccuucuggaugugcagcaacggcucccuccagugccggaucugcaucuga

SEQ ID NO: 5724 - RNA, 1701 nt, Artificial Sequence; identical to SEQ ID NO: 5081
  derived and/or modified CDS sequence (AUadapt) from InfluenzaA__ADL32464__HA

SEQ ID NO: 5725 - RNA, 1701 nt, Artificial Sequence; identical to SEQ ID NO: 5081
  derived and/or modified CDS sequence (AUadapt) from InfluenzaA__ADL32484__HA

SEQ ID NO: 5726 - RNA, 1701 nt, Artificial Sequence
  derived and/or modified CDS sequence (AUadapt) from InfluenzaA__ADL32504__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcaugugcuaccccggcgacuucaucgacuacgaggagcuccgggagcagcugagcuccgugucguccuucgagcgcuucgagaucuuccccaagacgagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcaccucccgguacagcaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccggguccggcaucaucaucucggacacccccgugcacgacugcaacacgaccugccagaccccgaagggcgccaucaacaccucccugcccuuccagaacauccaccccaucacgaucgggaagugccccaaguacgucaagagcaccaagcugcggcucgcgaccggccugcgcaacgugccguccauccagucgcgggggcuguucggcgccaucgccggguucaucgagggcggcuggaccgggaugguggacggcugguacggguaccaccaccagaacgagcagggcuccggguacgccgccgaccucaagagcacgcagcacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgacccgcaucuaccagauccuggcgaucuacuccaccgucgccagcucgcuggugcucguggucucccugggggccaucagcuucuggaugugcuccaacggcagccugcagugccggaucugcaucuga

SEQ ID NO: 5727 - RNA, 1701 nt, Artificial Sequence; identical to SEQ ID NO: 4334
  derived and/or modified CDS sequence (AUadapt) from InfluenzaA__ADL32514__HA

SEQ ID NO: 5728 - RNA, 1701 nt, Artificial Sequence; identical to SEQ ID NO: 5081
  derived and/or modified CDS sequence (AUadapt) from InfluenzaA__ADL32524__HA

SEQ ID NO: 5729 - RNA, 1701 nt, Artificial Sequence
  derived and/or modified CDS sequence (AUadapt) from InfluenzaA__ADL32544__HA
augaaggccauccuggugguccuccuguacaccuucgccaccucgaacgcggacacgcugugcaucggcuaccacgccaacaacuccaccgacaccguggacaccgugcucgagaagaacgucacggugacccacucggugaaccugcuggaggacaagcacaacgggaagcucugcaagcugcgcggcgucgcgccccugcaccucgggaagugcaacaucgccggcuggauccuggggaacccggagugcgagucccugagcaccgccuccucgugguccuacaucguggagaccagcuccucggacaacggcacgugcuaccccggcgacuucaucgacuacgaggagcuccgggagcagcuguccagcguguccucguucgagcgcuucgagaucuuccccaagaccuccagcuggcccaaccacgacuccaacaagggggucaccgccgccugcccgcacgccggcgccaagucguucuacaagaaccugaucuggcucgugaagaaggggaacuccuaccccaagcugcgcaagagcuacaucaacgacaagggcaaggaggugcugguccucugggggauccaccaccccucgaccuccgcggaccagcagagccuguaccagaacgccgacgccuacguguucgugggcacgucccgguacucgaagaaguucaagcccgagaucgccauccggccgaagguccgcgaccaggagggccggaugaacuacuacuggacccugguggagcccggggacaagaucaccuucgaggccaccggcaaccucguggucccccgcuacgcguucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcgccucgccaccggccugcggaacgugccguccauccagagccgcgggcuguucggcgcgaucgccggguucaucgagggcggcuggacggggaugguggacggcugguacggguaccaccaccagaacgagcagggcuccggguacgccgccgaccucaagucgacccagcacgccaucgacgagaucaccaacaaggugaacuccgucaucgagaagaugaacacccaguucacggcggugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggccaucuacuccaccgucgcgucgagccuggugcucguggucucccugggggccaucucguucuggaugugcuccaacggcagccugcagugccgcaucugcaucuga

SEQ ID NO: 5730 - RNA, 1701 nt, Artificial Sequence; identical to SEQ ID NO: 5515
  derived and/or modified CDS sequence (AUadapt) from InfluenzaA__ADL32554__HA

SEQ ID NO: 5731 - RNA, 1701 nt, Artificial Sequence; identical to SEQ ID NO: 4527
  derived and/or modified CDS sequence (AUadapt) from InfluenzaA__ADL32670__HA

SEQ ID NO: 5732 - RNA, 1701 nt, Artificial Sequence
  derived and/or modified CDS sequence (AUadapt) from InfluenzaA__ADL32690__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccucguccuggagcuacaucguggagaccuccucguccgacaacggcacgugcuaccccggcgacuucaucgacuacgaggagcugcgggagcagcucagcuccgugucguccuucgagcgcuucgagaucuuccccaagaccagcuccuggcccaaccacgacucgaacaagggggucaccgccgccugcccgcacgccggcgcgaaguccuucuacaagaaccugauguggcuggugaagaaggggaacagcuaccccaagcucuccaagucguacaucaacgacaagggcaaggaggugcugguccugugggggauccaccaccccagcaccuccgccgaccagcagucgcucuaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggucgggcaucaucaucuccgacacccccgugcacgacugcaacacgaccugccagaccccgaagggcgccaucaacaccagccuccccuuccagaacauccaccccaucacgaucgggaagugccccaaguacgugaaguccaccaagcugcggcuggcgaccggccuccgcaacgucccgucgauccagucccgggggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacucggucaucgagaagaugaacacccaguucaccgccgugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcuggaguccacccgcaucuaccagauccucgcgaucuacagcaccgucgccucgucccuggugcugguggucagccucggggccaucuccuucuggaugugcagcaacggcucccugcagugccggaucugcaucuga

SEQ ID NO: 5733 - RNA, 1701 nt, Artificial Sequence; identical to SEQ ID NO: 96
  derived and/or modified CDS sequence (AUadapt) from InfluenzaA__ADL32710__HA

SEQ ID NO: 5734 - RNA, 1701 nt, Artificial Sequence; identical to SEQ ID NO: 116
  derived and/or modified CDS sequence (AUadapt) from InfluenzaA__ADL32720__HA

SEQ ID NO: 5735 - RNA, 1701 nt, Artificial Sequence; identical to SEQ ID NO: 4686
  derived and/or modified CDS sequence (AUadapt) from InfluenzaA__ADL32730__HA

SEQ ID NO: 5736 - RNA, 1701 nt, Artificial Sequence; identical to SEQ ID NO: 4686
  derived and/or modified CDS sequence (AUadapt) from InfluenzaA__ADL32740__HA

SEQ ID NO: 5737 - RNA, 1701 nt, Artificial Sequence; identical to SEQ ID NO: 3858
  derived and/or modified CDS sequence (AUadapt) from InfluenzaA__ADL39137__HA

SEQ ID NO: 5738 - RNA, 1698 nt, Artificial Sequence
  derived and/or modified CDS sequence (AUadapt) from InfluenzaA__ADL39148__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccucgguguccagcuucgagcgguucgagaucuucccgaaggaguccagcuggcccaaccacacggucaccgggguguccgccagcugcucccacaacggcgagucguccuucuaccgcaaccugcuguggcucaccgggaagaacggccuguaccccaaccugagcaaguccuacgccaacaacaaggagaaggaggugcucguccuguggggcgugcaccacccgcccaacaucguggaccagaagacccuguaccggacggagaacgccuacgucagcguggugagcucccacuacucgcgcaaguucacccccgagaucgccaagcggcccaagguccgcgaccaggagggccggaucaacuacuacuggacccuccuggagcccggcgacaccaucaucuucgaggccaacgggaaccugaucgcgccgcgcuacgccuucgcccucucccgggacuucggcagcgggaucaucaacuccaacgcccccauggacaagugcgacgccaagugccagacgccccagggcgcgaucaacagcucccugcccuuccagaacgugcacccggugaccaucggcgagugccccaaguacguccgcagcgccaagcugcggauggugaccgggcuccgcaacauccccuccauccagucgcggggccuguucggggccaucgccggcuucaucgagggcggguggaccggcaugguggacgggugguacggcuaccaccaccagaacgagcagggguccggcuacgccgcggaccagaaguccacgcagaacgccaucaacgggaucaccaacaaggucaacagcgugaucgagaagaugaacacccaguucaccgccgucggcaaggaguucaacaagcuggagcgccggauggagaaccucaacaagaagguggacgacggcuucaucgacaucuggacguacaacgccgagcugcuggugcuccuggagaacgagcgcacccuggacuuccacgacagcaacgucaagaaccucuacgagaaggugaagucccagcugaagaacaacgccaaggagaucgggaacggcugcuucgaguucuaccacaagugcaacgacgagugcauggagagcgugaagaacgggaccuacgacuaccccaaguacuccgaggagucgaagcugaaccgggagaagaucgacggcgucaagcucgaguccauggggguguaccagauccuggcgaucuacagcaccguggccagcucccugguccuccuggugagccugggcgccaucuccuucuggaugugcagcaacggcucccuccagugccgcaucugcaucuga

SEQ ID NO: 5739 - RNA, 1701 nt, Artificial Sequence
  derived and/or modified CDS sequence (AUadapt) from InfluenzaA__ADL39159__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagaucaucgacggcgagaacugcacccucaucgacgcccugcugggggacccccagugcgacggcuuccagaacaagaagugggaccucuucguggagcgcuccaaggccuacuccaacugcuaccccuacgacgugccggacuacgcgagccugcggucccuggucgccucguccggcacgcucgaguucaacaacgagagcuucaacuggaccggggugacccagaacggcaccuccucggccugcauccgccgguccaacaacagcuucuucucccgccugaacuggcugacgcaccucaaguucaaguaccccgcccugaacgugaccaugcccaacaacgagcaguucgacaagcuguacaucuggggcguccaccaccccgggaccgacaacgaccagaucuuccucuacgcgcaggccucggggcggaucaccguguccacgaagcgcagccagcagaccgugaucccgaacaucggcucgcggccccgcguccggaacauccccucccgcaucagcaucuacuggaccaucgugaagcccggcgacauccugcugaucaacuccaccgggaaccucaucgccccgcggggcuacuucaagauccgcucggggaaguccagcaucaugcgguccgacgcccccaucggcaagugcaacucggagugcaucacgcccaacggcuccauccccaacgacaagccguuccagaacgugaaccgcaucaccuacggggccugcccccgguacgucaagcagaacacccugaagcuggcgaccggcaugcgcaacgugcccgagaagcagacgcgggggaucuucggcgccaucgccggguucaucgagaacggcugggagggcaugguggacgggugguacggcuuccgccaccagaacagcgaggggcggggccaggccgccgaccucaaguccacccaggcggccaucgaccagaucaacgggaagcugaaccgccugaucggcaagaccaacgagaaguuccaccagaucgagaaggaguucucggaggucgagggccggauccaggaccucgagaaguacguggaggacaccaagaucgaccugugguccuacaacgccgagcugcucguggcccuggagaaccagcacacgaucgaccugaccgacagcgagaugaacaagcuguucgagaagaccaagaagcagcuccgcgagaacgccgaggacauggggaacggcugcuucaagaucuaccacaagugcgacaacgcgugcauccgcuccauccggaacgggaccuacgaccacgacgucuaccgcgacgaggcccugaacaaccgguuccagaucaagggcguggagcucaagucgggguacaaggacuggauccuguggaucuccuucgccaucagcugcuuccugcucugcuucgcccugcugggcuucaucaugugggccugccagaagggcaacauccgcugcaacaucugcaucuga

SEQ ID NO: 5740 - RNA, 1701 nt, Artificial Sequence
  derived and/or modified CDS sequence (AUadapt) from InfluenzaA__ADL39170__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaagaacagcuucuucucccgccugaacuggcucacgcaccugaacuucaaguaccccgcccugaacgugaccguccccaacaacgagcaguucgacaagcucuacaucuggggcgugcaccaccccgggaccgacaaggaccagaucuuccuguacgcgcaggccucggggcggaucaccguguccacgaagcgcagccagcagaccgucaucccgaacaucggcucgcggccccgcgugcggaacauccccucccgcaucagcaucuacuggaccaucgugaagcccggcgacguccugcucaucaacuccaccgggaaccugaucgccccgcggggcuacuucaagauccgcucggggaaguccucgaucaugcgguccgacgcccccaucggcaagugcaacagcgagugcaucacgcccaacggcuccauccccaacgacaagccguuccagaacgugaaccgcaucaccuacggggccugcccccgguacgugaagcagaacacccugaagcucgcgaccggcaugcgcaacguccccgagaagcagacgcgggggaucuucggcgccaucgccggguucaucgagaacggcugggagggcaugguggacgggugguacggcuuccgccaccagaacucggaggggcggggccaggccgccgaccugaaguccacccaggcggccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacacgaucgaccucaccgacucggagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacguguaccgggacgaggcccucaacaaccgcuuccagaucaagggggucgagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 5741 - RNA, 1701 nt, Artificial Sequence; identical to SEQ ID NO: 3858
  derived and/or modified CDS sequence (AUadapt) from InfluenzaA__ADL39203__HA

SEQ ID NO: 5742 - RNA, 1701 nt, Artificial Sequence; identical to SEQ ID NO: 2679
  derived and/or modified CDS sequence (AUadapt) from InfluenzaA__ADL39214__HA

SEQ ID NO: 5743 - RNA, 1698 nt, Artificial Sequence
  derived and/or modified CDS sequence (AUadapt) from InfluenzaA__ADL39225__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggcuacuucgccgacuacgaggagcugcgcgagcagcucuccagcguguccagcuucgagcgguucgagaucuucccgaaggaguccucguggcccaaccacacggucaccggggccuccgccagcugcucccacaacggcgagaacagcuucuaccgcaaccugcuguggcucaccgggaagaacggccuguaccccaaccuguccaagucguacgccaacaacaaggagaaggaggugcucgugcuguggggcguccaccacccgcccaacaucgccgaccagaagacccuguaccacacggagaacgccuacguguccguggucagcagccacuacucccggaaguucacccccgagaucgcgaagcgccccaaggugcgggaccaggagggccgcaucaacuacuacuggacccuccuggagcccggcgacaccaucaucuucgaggccaacgggaaccugaucgccccgcgguacgccuucgcccucucgcgcggcuucggguccggcaucaucaacagcaacgcgcccauggacaagugcgacgccaagugccagacgccccagggcgccaucaacuccagccugcccuuccagaacgugcacccggucaccaucggggagugccccaaguacgugcgguccgccaagcugcgcauggugaccggccuccggaacauccccucgauccagucccgcgggcuguucggcgccaucgcgggguucaucgagggcggcuggaccgggauggucgacggcugguacggguaccaccaccagaacgagcagggcagcggguacgccgccgaccagaaguccacgcagaacgccaucaacggcaucaccaacaaggugaacagcgugaucgagaagaugaacacccaguucaccgccgucggcaaggaguucaacaagcuggagcggcgcauggagaaccucaacaagaagguggacgacggguucaucgacaucuggacguacaacgcggagcugcugguccuccuggagaacgagcggacccuggacuuccacgacuccaacgugaagaaccucuacgagaaggucaagucgcagcugaagaacaacgccaaggagaucggcaacgggugcuucgaguucuaccacaagugcaacgacgagugcauggaguccgugaagaacggcaccuacgacuaccccaaguacagcgaggaguccaagcugaaccgcgagaagaucgacggggugaagcucgagagcaugggcguguaccagauccuggccaucuacuccaccgucgccucgagccuggugcuccuggugucccugggcgccaucagcuucuggaugugcuccaacgggagccuccagugccggaucugcaucuga

SEQ ID NO: 5744 - RNA, 1698 nt, Artificial Sequence
  derived and/or modified CDS sequence (AUadapt) from InfluenzaA__ADL39236__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggcuacuucgccgacuacgaggagcugcgcgagcagcucuccagcguguccucguucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacaccaacaacaaggagaaggaggugcucguccuguggggcgugcaccacccgcccaacaucguggaccagaagacgcuguaccggaccgagaacgccuacgucucgguggugagcucccacuacagccgcaaguucacccccgagaucgccaagcggcccaagguccgcgaccaggagggccggaucaacuacuacuggacccuccuggagcccggcgacacgaucaucuucgaggccaacgggaaccugaucgccccgcgcuacgcguucgcccucucccggggcuucgggagcggcaucaucaacuccaacgcccccaugggcaagugcgacgccaagugccagacgccccagggggccaucaacagcucccugcccuuccagaacgugcacccggugaccaucggcgagugccccaaguacguccgcucggcgaagcugcggauggugaccgggcuccgcaacauccccuccauccagagccggggccuguucggggccaucgccggcuucaucgagggcggguggaccggcaugguggacgggugguacggcuaccaccaccagaacgagcagggguccggcuacgccgccgaccagaaguccacccagaacgcgaucaacggcaucaccaacaaggucaacagcgugaucgagaagaugaacacccaguucacggccgucgggaaggaguucaacaagcuggagcgccggauggagaaccucaacaagaagguggacgacggcuucaucgacaucuggaccuacaacgccgagcugcuggugcuccuggagaacgagcgcacccuggacuuccacgacagcaacgucaagaaccucuacgagaaggugaagucccagcugaagaacaacgccaaggagaucgggaacggcugcuucgaguucuaccacaagugcaacgacgagugcauggagagcgugaagaacgggaccuacgacuaccccaaguacuccgaggagucgaagcugaaccgggagaagaucgacggcgucaagcucgaguccaugggcguguaccagauccuggccaucuacagcacgguggcgagcucccugguccuccuggugagccugggggccaucuccuucuggaugugcagcaacggcucccuccagugccgcaucugcaucuga

SEQ ID NO: 5745 - RNA, 1701 nt, Artificial Sequence
  derived and/or modified CDS sequence (AUadapt) from InfluenzaA__ADL39280__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcaccuccgguucaaguaccccgcccugaacgugaccaugcccaacaacgagcaguucgacaagcuguacaucuggggcguccaccaccccgggaccgacaacgaccagaucuuccuguacgcgcaggccucggggcgcaucaccguguccacgaagcggagccagcagaccgugaucccgaacaucggcucgcgcccccggguccgcaacauccccucccggaucagcaucuacuggaccaucgugaagcccggcgacauccugcucaucaacuccaccgggaaccugaucgccccgcgcggcuacuucaagauccggucggggaaguccucgaucaugcgcuccgacgcccccaucggcaagugcaacagcgagugcaucacgcccaacggcuccauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggguucaucgagaacggcugggagggcaugguggacgggugguacggcuuccggcaccagaacucggaggggcgcggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgcgagaacgccgaggacauggggaacggcugcuucaagaucuaccacaagugcgacaacgcgugcaucggguccauccggaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 5746 - RNA, 1698 nt, Artificial Sequence
  derived and/or modified CDS sequence (AUadapt) from InfluenzaA__ADL39291__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccggcguguccgccucgugcucccacaacggcgagagcuccuucuaccgcaaccugcuguggcucaccgagaagaacgggcuguaccccaaccugagcaaguccuacgccaacaacaaggagaaggaggugcucguccuguggggcgugcaccacccgcccaacaugggggaccagaagacccuguaccacacggagaacgccuacgugucggucgugagcucccacuacagccggaaguucacccccgagaucgccaagcgccccaaggugcgggaccaggagggccgcaucaacuacuacuggacccuccuggagcccggcgacaccaucaucuucgaggccaacgggaaccugaucgcgccgcgguacgccuucgcccucucccgcggcuucgggagcggcaucaucaacuccaacgcccccauggacaagugcgacgccaagugccagacgccccagggcgcgaucaacucgucccugcccuuccagaacguccacccggugaccaucggggagugccccaaguacgugcggagcgccaagcugcgcauggucaccggccuccggaacauccccuccauccagagccgcgggcuguucggcgccaucgccggguucaucgagggcggcuggaccgggaugguggacggcugguacggguaccaccaccagaacgagcagggcuccggguacgccgcggaccagaaguccacgcagaacgccaucaacggcaucaccaacaaggugaacucggucaucgagaagaugaacacccaguucaccgccgugggcaaggaguucaacaagcuggagcggcgcauggagaaccucaacaagaaggucgacgacggguucaucgacaucuggacguacaacgccgagcugcuggugcuccuggagaacgagcggacccuggacuuccacgacagcaacgugaagaaccucuacgagaaggucaagucccagcugaagaacaacgccaaggagaucggcaacgggugcuucgaguucuaccacaagugcaacgacgagugcauggagagcgugaagaacggcaccuacgacuaccccaaguacuccgaggagagcaagcugaaccgcgagaagaucgacggggugaagcucgaguccaugggcgucuaccagauccuggcgaucuacucgaccguggccagcucccuggugcuccuggucagccugggcgccaucuccuucuggaugugcagcaacgggucccuccagugccggaucugcaucuga

SEQ ID NO: 5747 - RNA, 1701 nt, Artificial Sequence; identical to SEQ ID NO: 2679
  derived and/or modified CDS sequence (AUadapt) from InfluenzaA__ADL39302__HA

SEQ ID NO: 5748 - RNA, 1701 nt, Artificial Sequence; identical to SEQ ID NO: 5745
  derived and/or modified CDS sequence (AUadapt) from InfluenzaA__ADL39313__HA

SEQ ID NO: 5749 - RNA, 1701 nt, Artificial Sequence
  derived and/or modified CDS sequence (AUadapt) from InfluenzaA__ADL39335__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcaccuccgguucaaguaccccgcccugaacgugaccaugcccaacaacgagcaguucgacaagcuguacaucuggggcguccaccaccccgggaccgacaacgaccagaucuuccuguacgcgcaggccucggggcgcaucaccguguccacgaagcggagccagcagaccgugaucccgaacaucggcucgcgcccccggguccgcaacauccccucccggaucagcaucuacuggaccaucgugaagcccggcgacauccugcucaucaacuccaccgggaaccugaucgccccgcgcggcuacuucaagauccggucggggaaguccucgaucaugcgcuccgacgcccccaucggcaagugcaacagcgagugcaucacgcccaacggcuccauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggguucaucgagaacggcugggagggcaugguggacgggugguacggcuuccggcaccagaacucggaggggcgcggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgauccaccucaccgacucggagaugaacaagcuguucgagaagaccaagaagcagcugcgcgagaacgccgaggacauggggaacggcugcuucaagaucuaccacaagugcgacaacgcgugcaucggguccauccggaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 5750 - RNA, 1701 nt, Artificial Sequence; identical to SEQ ID NO: 2679
  derived and/or modified CDS sequence (AUadapt) from InfluenzaA__ADL39368__HA

SEQ ID NO: 5751 - RNA, 1698 nt, Artificial Sequence
  derived and/or modified CDS sequence (AUadapt) from InfluenzaA__ADL39390__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccucgguguccagcuucgagcgguucgagaucuucccgaaggaguccagcuggcccaaccacacggucaccgggguguccgccagcugcucccacaacggcgagucguccuucuaccgcaaccugcuguggcucaccgggaagaacggccuguaccccagccuguccaagagcuacgccaacaacaaggagaaggaggugcucguccuguggggcgugcaccacccgcccaacaucguggaccagaagacccuguaccggacggagaacgccuacgucagcgugguguccagccacuacucccgcaaguucacccccgagaucgccaagcggcccaagguccgcgaccaggagggccggaucaacuacuacuggacccuccuggagcccggcgacaccaucaucuucgaggccaacgggaaccugaucgcgccgcgcuacgccuucgcccucucgcggggcuucggguccggcaucaucaacagcaacgcccccaugggcaagugcgacgccaagugccagacgccccagggggcgaucaacuccagccugcccuuccagaacgugcacccggugaccaucggcgagugccccaaguacguccgcuccgccaagcugcggauggugaccgggcuccgcaacauccccagcauccagucccggggccuguucggggccaucgccggcuucaucgagggcggguggaccggcaugguggacgggugguacggcuaccaccaccagaacgagcaggggucgggcuacgccgcggaccagaaguccacgcagaacgccaucaacggcaucaccaacaaggucaacagcgugaucgagaagaugaacacccaguucaccgccgucgggaaggaguucaacaagcuggagcgccggauggagaaccucaacaagaagguggacgacggcuucaucgacaucuggacguacaacgccgagcugcuggugcuccuggagaacgagcgcacccuggacuuccacgacuccaacgucaagaaccucuacgagaaggucaagagccagcugaagaacaacgccaaggagaucgggaacggcugcuucgaguucuaccacaagugcaacgacgagugcauggaguccgugaagaacgggaccuacgacuaccccaaguacagcgaggaguccaagcugaaccgggagaagaucgacggcgugaagcucgagucgaugggcguguaccagauccuggcgaucuacagcaccguggccuccagccugguccuccuggugucccugggggccaucagcuucuggaugugcuccaacggcagccuccagugccgcaucugcaucuga

SEQ ID NO: 5752 - RNA, 1701 nt, Artificial Sequence
  derived and/or modified CDS sequence (AUadapt) from InfluenzaA__ADL39401__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcuccugcaugcgccggucgaacaacuccuucuucagccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcccaggcguccgggcggaucaccgugucgacgaagcgcagccagcagaccgugaucccgaacaucggcucccggccccgcguccggaacauccccucgcgcaucuccaucuacuggaccaucgugaagcccggcgacauccugcucaucaacagcaccgggaaccugaucgccccgcggggcuacuucaagauccgcuccgggaaguccuccaucaugcggucggacgcccccaucggcaagugcaacuccgagugcaucacgcccaacggcagcauccccaacgacaagccguuccagaacgugaaccgcaucaccuacggggccugcccccgguacgucaagcagaacacccugaagcucgccaccggcaugcgcaacgugcccgagaagcagacgcgggggaucuucggcgcgaucgccggguucaucgagaacggcugggagggcaugguggacgggugguacggcuuccgccaccagaacuccgaggggcggggccaggccgccgaccucaagucgacccaggccgcgaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgccugcaucgggucgauccgcaacggcaccuacgaccacgacgucuaccgggacgaggcgcucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 5753 - RNA, 1701 nt, Artificial Sequence
  derived and/or modified CDS sequence (AUadapt) from InfluenzaA__ADL39412__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccucggggcggaucaccguguccacgaagcgcagccagcagaccgugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggagaaguccucgaucaugcgguccgacgcccccaucgggaagugcaacagcgagugcaucacgcccaacggcuccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacgggugggagggcaugguggacggcugguacggguuccgccaccagaacucggagggccgggggcaggccgccgaccugaaguccacccaggcggccaucgaccagaucaacggcaagcugaaccgccucaucgggaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggguacaaggacuggauccuguggaucuccuucgccaucagcugcuuccuccugugcguggcccugcucggcuucaucaugugggccugccagaagggcaacauccggugcaacaucugcaucuga

SEQ ID NO: 5754 - RNA, 1698 nt, Artificial Sequence
  derived and/or modified CDS sequence (AUadapt) from InfluenzaA__ADL39423__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccucguggcccucccacacggucaccggggugagcgccuccugcagccacaacggcgagaacuccuucuaccgcaaccugcuguggcucaccgggaagaacggccuguaccccaaccugucgaaguccuacgccaacaacaaggagaaggaggugcucguccuguggggcgugcaccacccgcccaacaucgccgaccagaagacccuguaccacacggagaacgccuacgugagcgucgugagcucccacuacucgcggaaguucacccccgagaucgccaagcgccccaaggugcgggaccaggagggccgcaucaacuacuacuggacccuccuggagcccggcgacaccaucaucuucgaggcgaacgggaaccugaucgccccgcgguacgccuucgcccucucccgcggcuucgggagcggcaucaucaacuccaacgcccccauggacaagugcgacgcgaagugccagacgccccagggcgccaucaacagcucccugcccuuccagaacguccacccggugaccaucggggagugccccaaguacgugcggucggccaagcugcgcauggucaccggccuccggaacauccccuccauccagagccgcgggcuguucggcgccaucgccggguucaucgagggcggcuggaccgggaugguggacggcugguacggguaccaccaccagaacgagcagggcuccggguacgcggccgaccagaaguccacgcagaacgccaucaacggcaucaccaacaaggugaacagcgucaucgagaagaugaacacccaguucaccgccgugggcaaggaguucaacaagcuggagcggcgcauggagaaccucaacaagaaggucgacgacggguucaucgacaucuggacguacaacgccgagcugcuggugcuccuggagaacgagcggacccuggacuuccacgacucgaacgugaagaaccucuacgagaaggucaagaaccagcugaagaacaacgcgaaggagaucggcaacgggugcuucgaguucuaccacaagugcaacgacgagugcauggaguccgugaagaacggcaccuacgacuaccccaaguacagcgaggaguccaagcugaaccgcgagaagaucgacggggugaagcucgagagcaugggcgucuaccagauccuggccaucuacuccaccguggccucgagccuggugcuccuggucucccugggcgccaucagcuucuggaugugcuccaacgggagccuccagugccggaucugcaucuga

SEQ ID NO: 5755 - RNA, 1701 nt, Artificial Sequence
  derived and/or modified CDS sequence (AUadapt) from InfluenzaA__ADL39434__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcaccuccgguucaaguaccccgcccugaacgugaccaugcccaacaacgagcaguucgacaagcuguacaucuggggcguccaccaccccgggaccgacaacgaccagaucuuccuguacgcgcaggccucggggcgcaucaccguguccacgaagcggagccagcagaccgugaucccgaacaucggcucgcgcccccggguccgcgacauccccucccggaucagcaucuacuggaccaucgugaagcccggcgacauccugcucaucaacuccaccgggaaccugaucgccccgcgcggcuacuucaagauccggucggggaaguccucgaucaugcgcuccgacgcccccaucggcaagugcaacagcgagugcaucacgcccaacggcuccauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggguucaucgagaacggcugggagggcaugguggacgggugguacggcuuccggcaccagaacucggaggggcgcggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgcgagaacgccgaggacauggggaacggcugcuucaagaucuaccacaagugcgacaacgcgugcaucggguccauccggaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 5756 - RNA, 1698 nt, Artificial Sequence
  derived and/or modified CDS sequence (AUadapt) from InfluenzaA__ADL39445__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccucgguguccagcuucgagcgguucgagaucuucccgaaggaguccagcuggcccaaccacacggucaccgggguguccgccagcugcucccacaacggcgagucguccuucuaccgcaaccugcuguggcucaccgggaagaacggccuguaccccacccugagcaaguccuacgccaacaacaaggagaaggaggugcucguccuguggggcgugcaccacccgcccaacaucguggaccagaagacgcuguaccggaccgagaacgccuacgucagcguggugagcucccacuacucgcgcaaguucacccccgagaucgccaagcggcccaagguccgcgaccaggagggccggaucaacuacuacuggacccuccuggagcccggcgacacgaucaucuucgaggccaacgggaaccugaucgcgccgcgcuacgccuucgcccucucccggggcuucgggagcggcaucaucaacuccaacgcccccauggacaagugcgacgccaagugccagacgccccagggcgcgaucaacagcucccugcccuuccagaacgugcacccggugaccaucggggagugccccaaguacguccgcagcgccaagcugcggauggugaccggccuccgcaacauccccuccauccagucgcgggggcuguucggcgccaucgccggguucaucgagggcggcuggaccgggaugguggacggcugguacggguaccaccaccagaacgagcagggcuccggguacgccgcggaccagaaguccacccagaacgccaucaacggcaucaccaacaaggucaacagcgugaucgagaagaugaacacccaguucacggccgucggcaaggaguucaacaagcuggagcgccggauggagaaccucaacaagaagguggacgacggguucaucgacaucuggaccuacaacgccgagcugcuggugcuccuggagaacgagcgcacccuggacuuccacgacagcaacgucaagaaccucuacgagaaggugaagucccagcugaagaacaacgccaaggagaucggcaacgggugcuucgaguucuaccacaagugcaacgacgagugcauggagagcgugaagaacggcaccuacgacuaccccaaguacuccgaggagucgaagcugaaccgggagaagaucgacggggucaagcucgaguccaugggcguguaccagauccuggcgaucuacagcacgguggccagcucccugguccuccuggugagccugggcgccaucuccuucuggaugugcagcaacgggucccuccagugccgcaucugcaucuga

SEQ ID NO: 5757 - RNA, 1698 nt, Artificial Sequence
  derived and/or modified CDS sequence (AUadapt) from InfluenzaA__ADL39456__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccucccacacggucaccggggugucggccuccugcagccacaacggcgagaacuccuucuaccgcaaccugcuguggcucaccgggaagaacggccuguaccccaaccugagcaaguccuacgccaacaacaaggagaaggaggugcucguccuguggggcgugcaccacccgcccaacaucgccgaccagaagacccuguaccacacggagaacgccuacgugucggucgugagcucccacuacagccggaaguucacccccgagaucgccaagcgccccaaggugcgggaccaggagggccgcaucaacuacuacuggacccuccuggagcccggcgacaccaucaucuucgaggcgaacgggaaccugaucgccccgcgguacgccuucgcccucucccgcggcuucgggagcggcaucaucaacuccaacgcccccauggacaagugcgacgcgaagugccagacgccccagggcgccaucaacucgucccugcccuuccagaacguccacccggugaccaucggggagugccccaaguacgugcggagcgccaagcugcgcauggucaccggccuccggaacauccccuccauccagagccgcgggcuguucggcgccaucgccggguucaucgagggcggcuggaccgggaugguggacggcugguacggguaccaccaccagaacgagcagggcuccggguacgcggccgaccagaaguccacgcagaacgccaucaacggcaucaccaacaaggugaacucggucaucgagaagaugaacacccaguucaccgccgugggcaaggaguucaacaagcuggagcggcgcauggagaaccucaacaagaaggucgacgacggguucaucgacaucuggacguacaacgccgagcugcuggugcuccuggagaacgagcggacccuggacuuccacgacagcaacgugaagaaccucuacgagaaggucaagucccagcugaagaacaacgcgaaggagaucggcaacgggugcuucgaguucuaccacaagugcaacgacgagugcauggagagcgugaagaacggcaccuacgacuaccccaaguacuccgaggagagcaagcugaaccgcgagaagaucgacggggugaagcucgaguccaugggcgucuaccagauccuggccaucuacucgaccguggccagcucccuggugcuccuggucagccugggcgccaucuccuucuggaugugcagcaacgggucccuccagugccggaucugcaucuga

SEQ ID NO: 5758 - RNA, 1698 nt, Artificial Sequence
  derived and/or modified CDS sequence (AUadapt) from InfluenzaA__ADL39467__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccucgguguccagcuucgagcgguucgagaucuucccgaaggaguccagcuggcccaaccacacggucaccgggguguccgccagcugcucccacaacggcgagucguccuucuaccgcaaccugcuguggcucaccgggaagaacggccuguaccccaaccugagcaaguccuacgccaacaacaaggagaaggaggugcucguccuguggggcgugcaccacccgcccaacaucguggaccagaagacccuguaccggacggagaacgccuacgucagcguggugagcucccacuacucgcgcaaguucacccccgagaucgccaagcggcccaagguccgcgaccaggagggccggaucaacuacuacuggacccuccuggagcccggcgacaccaucaucuucgaggccaacgggaaccugaucgcgccgcgcuacgccuucgcccucucccggggcuucgggagcggcaucaucaacuccaacgcccccaugggcaagugcgacgccaagugccagacgccccagggggcgaucaacagcucccugcccuuccagaacgugcacccggugaccaucggcgagugccccaaguacguccgcagcgccaagcugcggauggugaccgggcuccgcaacauccccuccauccagucgcggggccuguucggggccaucgccggcuucaucgagggcggguggaccggcaugguggacgggugguacggcuaccaccaccagaacgagcagggguccggcuacgccgcggaccagaaguccacgcagaacgccaucaacggcaucaccaacaaggucaacagcgugaucgagaagaugaacacccaguucaccgccgucgggaaggaguucaacaagcuggagcgccggauggagaaccucaacaagaagguggacgacggcuucaucgacaucuggacguacaacgccgagcugcuggugcuccuggagaacgagcgcacccuggacuuccacgacagcaacgucaagaaccucuacgagaaggugaagucccagcugaagaacaacgccaaggagaucgggaacggcugcuucgaguucuaccacaagugcaacgacgagugcauggagagcgugaagaacgggaccuacgacuaccccaaguacuccgaggagucgaagcugaaccgggagaagaucgacggcgucaagcucgaguccaugggcguguaccagauccuggcgaucuacagcaccguggccagcucccugguccuccuggugagccugggggccaucuccuucuggaugugcagcaacggcucccuccagugccgcaucugcaucuga

SEQ ID NO: 5759 - RNA, 1701 nt, Artificial Sequence; identical to SEQ ID NO: 116
  derived and/or modified CDS sequence (AUadapt) from InfluenzaA__ADL41164__HA

SEQ ID NO: 5760 - RNA, 1701 nt, Artificial Sequence; identical to SEQ ID NO: 3007
  derived and/or modified CDS sequence (AUadapt) from InfluenzaA__ADL41173__HA

SEQ ID NO: 5761 - RNA, 1698 nt, Artificial Sequence
  derived and/or modified CDS sequence (AUadapt) from InfluenzaA__ADL60242__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccucguggcccaaccacacggucaccgggguguccgccagcugcucccacaacggcgagcgcagcuucuaccggaaccugcuguggcucaccgggaagaacggccuguaccccaaccuguccaagucguacgccaacaacaaggagaaggaggugcucguccuguggggcgugcaccacccgcccgacaucggcaaccagaagacccuguaccacacggagaacgccuacguguccgucgugagcagccacuacucccgcaaguucacccccgagaucgccaagcggcccaaggugcgcgaccaggagggccggaucaacuacuacuggacccuccuggagcccggggacaccaucaucuucgaggccaacggcaaccugaucgcgccgcgcuacgccuucgcccucucgcggggguucggcuccggcaucaucaacagcaacgcccccauggacaagugcgacgccaagugccagacgccccagggggcgaucaacuccagccugcccuuccagaacguccacccggugaccaucggcgagugccccaaguacgugcgcuccgccaagcugcggauggucaccgggcuccgcaacauccccucgauccagucccggggccuguucggggccaucgccggcuucaucgagggcggguggaccggcaugguggacgggugguacggcuaccaccaccagaacgagcaggggagcggcuacgccgcggaccagaaguccacgcagaacgccaucaacggcaucaccaacaaggugaacagcgucaucgagaagaugaacacccaguucaccgccguggggaaggaguucaacaagcuggagcgccggauggagaaccucaacaagaaggucgacgacggcuucaucgacaucuggacguacaacgccgagcugcuggugcuccuggagaacgagcgcacccuggacuuccacgacuccaacgugaagaaccucuacgagaaggucaagucgcagcugaagaacaacgccaaggagaucgggaacggcugcuucgaguucuaccacaagugcaacgacgagugcauggaguccgugaagaacgggaccuacgacuaccccaaguacagcgaggaguccaagcugaaccgggagaagaucgacggcgugaagcucgagagcaugggcgucuaccagauccuggcgaucuacuccaccguggccucgagccuggugcuccuggucucccugggggccaucagcuucuggaugugcuccaacggcagccuccagugccgcaucugcaucuga

SEQ ID NO: 5762 - RNA, 1698 nt, Artificial Sequence
  derived and/or modified CDS sequence (AUadapt) from InfluenzaA__ADL60253__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcggccuccugaucagcaaggaguccuggagcuacaucguggagaagcccaaccccgagaacgggaccugcuaccccggguacuucgccgacuacgaggagcugcgcgagcagcucuccucgguguccagcuucgagcgguucgagaucuucccgaaggaguccagcuggcccaaccacacggucaccggcguguccgccagcugcucccacaacggggagucguccuucuaccgcaaccugcuguggcucaccggcaagaacgggcuguaccccaaccugagcaaguccuacgccaacaacaaggagaaggaggugcucguccuguggggcgugcaccacccgcccaacaucggcaaccagaaggcccuguaccacaccgagaacgccuacgugagcgucgugagcucccacuacucgcggaaguucacgcccgagaucgccaagcgccccaaggugcgggaccaggaggggcgcaucaacuacuacuggacccuccuggagcccggcgacaccaucaucuucgaggcgaacgggaaccugaucgccccgcgguacgccuucgcccucucccgcggcuucggcagcgggaucaucaacuccaacgcccccauggacaagugcgacgcgaagugccagacgccccagggcgccaucaacagcucccugcccuuccagaacguccacccggugaccaucggggagugccccaaguacgugcggagcgccaagcugcgcauggucaccggccuccggaacauccccuccauccagucgcgcgggcuguucggcgccaucgccggcuucaucgagggcggcuggaccgggaugguggacggcugguacggguaccaccaccagaacgagcagggcuccggcuacgcggccgaccagaaguccacccagaacgccaucaacgggaucacgaacaaggugaacagcgucaucgagaagaugaacacccaguucaccgccgugggcaaggaguucaacaagcuggagcggcgcauggagaaccucaacaagaaggucgacgacggguucaucgacaucuggaccuacaacgccgagcugcuggugcuccuggagaacgagcggacgcuggacuuccacgacagcaacgugaagaaccucuacgagaaggucaagucccagcugaagaacaacgcgaaggagaucggcaacgggugcuucgaguucuaccacaagugcaacgacgagugcauggagagcgugaagaacggcaccuacgacuaccccaaguacuccgaggagucgaagcugaaccgcgagaagaucgacggcgugaagcucgaguccaugggggucuaccagauccuggccaucuacagcaccguggccagcucccuggugcuccuggucagccugggcgccaucuccuucuggaugugcagcaacgggucccuccagugccggaucugcaucuga

SEQ ID NO: 5763 - RNA, 1698 nt, Artificial Sequence; identical to SEQ ID NO: 5761
  derived and/or modified CDS sequence (AUadapt) from InfluenzaA__ADL60264__HA

SEQ ID NO: 5764 - RNA, 1698 nt, Artificial Sequence; identical to SEQ ID NO: 5761
  derived and/or modified CDS sequence (AUadapt) from InfluenzaA__ADL60275__HA

SEQ ID NO: 5765 - RNA, 1698 nt, Artificial Sequence
  derived and/or modified CDS sequence (AUadapt) from InfluenzaA__ADL60286__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccucgguguccagcuucgagcgguucgagaucuucccgaaggaguccagcuggcccaaccacacggucaccgggguguccgccagcugcucccacaacggcgagucguccuucuaccgcaaccugcuguggcucaccgggaagaacggccuguaccccaaccugagcaaguccuacgccaacaacaaggagaaggaggugcucguccuguggggcgugcaccacccgcccagcaucagcaaccagaagacccuguaccacacggagaacgccuacguguccgucgugagcucccacuacucgcggaaguucacccccgagguggccaagcgccccaagguccgggaccaggagggccgcaucaacuacuacuggacccuccuggagcccggcgacaccaucaucuucgaggccaacgggaaccugaucgcgccgcgguacgccuucgcccucucccgcggcuucgggagcggcaucaucaacuccaacgcccccauggacaagugcgacgccaagugccagacgccccagggcgcgaucaacagcucccugcccuuccagaacgugcacccggugaccaucggggagugccccaaguacguccggagcgccaagcugcgcauggugaccggccuccggaacauccccuccauccagucgcgcgggcuguucggcgccaucgccggguucaucgagggcggcuggaccgggaugguggacggcugguacggguaccaccaccagaacgagcagggcuccggguacgccgcggaccagaaguccacgcagaacgccaucaacggcaucaccaacaaggucaacagcgugaucgagaagaugaacacccaguucaccgccgucggcaaggaguucaacaagcuggagcggcgcauggagaaccucaacaagaagguggacgacggguucaucgacaucuggacguacaacgccgagcugcuggugcuccuggagaacgagcggacccuggacuuccacgacagcaacgucaagaaccucuacgagaaggugaagucccagcugaagaacaacgccaaggagaucggcaacgggugcuucgaguucuaccacaagugcaacgacgagugcauggagagcgugaagaacggcaccuacgacuaccccaaguacuccgaggagucgaagcugaaccgcgagaagaucgacggggucaagcucgagagcaugggcguguaccagauccuggcgaucuacuccaccguggccagcucccugguccuccuggugagccugggcgccaucuccuucuggaugugcagcaacgggucccuccagugccggaucugcaucuga

SEQ ID NO: 5766 - RNA, 1698 nt, Artificial Sequence
  derived and/or modified CDS sequence (AUadapt) from InfluenzaA__ADL60297__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucucgaaggaguccuggagcuacaucguggagaagcccaaccccgagaacgggaccugcuaccccggccacuucgccgacuacgaggagcugcgcgagcagcucuccagcguguccucguucgagcgguucgagaucuucccgaaggaguccagcuggcccaaccacacggucaccggcguguccgccagcugcucccacaacggcgagucguccuucuaccgcaaccugcuguggcucacccggaagaacgggcuguaccccaaccugagcaaguccuacgccaacaacaaggagaaggaggugcucguccuguggggcgugcaccacccgcccaacaucggggaccagaagacccuguaccacacggagaacgccuacgugagcgucgugucgucccacuacagccgcaaguucacccccgagaucgccaagcggcccaaggugcgcgaccaggagggccggaucaacuacuacuggacccuccuggagcccggcgacaccaucaucuucgaggccaacgggaaccugaucgcgccgcgcuacgccuucgcccucucccggggcuucgggagcggcaucaucaacuccaacgcccccauggacaagugcgacgccaagugccagacgccccagggcgcgaucaacucgucccugcccuuccagaacguccacccggugaccaucggggagugccccaaguacgugcgcagcgccaagcugcggauggucaccggccuccgcaacauccccuccauccagagccgggggcuguucggcgccaucgccggguucaucgagggcggcuggaccgggaugguggacggcugguacggguaccaccaccagaacgagcagggcuccggguacgccgcggaccagaaguccacgcagaacgccaucaacggcaucaccaacaaggugaacucggucaucgagaagaugaacacccaguucaccgccgugggcaaggaguucaacaagcuggagcgccggauggagaaccucaacaagaaggucgacgacggguucaucgacaucuggacguacaacgccgagcugcuggugcuccuggagaacgagcgcacccuggacagccacgacuccaacgugaagaaccucuacgagaaggucaagagccagcugaagaacaacgccaaggagaucggcaacgggugcuucgaguucuaccacaagugcaacgacgagugcauggaguccgugaagaacggcaccuacgacuaccccaaguacucggaggaguccaagcugaaccgggagaagaucgacggggugaagcucgagagcaugggcgucuaccagauccuggcgaucuacagcaccguggccuccucgcuggugcuccuggucucccugggcgccaucagcuucuggaugugcuccaacgggagccuccagugccgcaucugcaucuga

SEQ ID NO: 5767 - RNA, 1698 nt, Artificial Sequence
  derived and/or modified CDS sequence (AUadapt) from InfluenzaA__ADL60308__HA
augaaggugaagcugcucguccugcugugcaccuucgccgccaccuacgcggacacgaucugcaucggcuaccacgccaacaacucgaccgacaccguggacaccgugcucgagaagaacgucacggugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccucgguguccagcuucgagcgguucgagaucuucccgaaggaguccagcuggcccaaccacaccgucacggggguguccgccagcugcucccacaacggcgagucguccuucuaccgcaaccugcuguggcucaccgggaagaacggccuguaccccaaccugagcaaguccuacgccaacaacaaggagaaggaggugcucguccuguggggcgugcaccacccgcccaacaucggcgugcagaaggcccuguaccacaccgagaacgccuacgucagcguggugagcucccacuacucgcggaaguucacccccgagaucgcgaagcgccccaagguccgggaccaggagggccgcaucaacuacuacuggacgcuccuggagcccggggacaccaucaucuucgaggccaacggcaaccugaucgccccgcgguacgccuucgcccucucccgcggguucggcagcggcaucaucaacuccaacgcgcccauggacaagugcgacgccaagugccagacgccccagggggccaucaacagcucccugcccuuccagaacgugcacccggugaccaucggcgagugccccaaguacguccggagcgccaagcugcgcauggugaccgggcuccggaacauccccuccauccagucgcgcggccuguucggggccaucgcgggcuucaucgagggcggguggaccggcaugguggacgggugguacggcuaccaccaccagaacgagcagggguccggcuacgccgccgaccagaaguccacccagaacgccaucaacggcaucaccaacaaggucaacagcgugaucgagaagaugaacacgcaguucaccgccgucgggaaggaguucaacaagcuggagcggcgcauggagaaccucaacaagaagguggacgacggcuucaucgacaucuggaccuacaacgcggagcugcuggugcuccuggagaacgagcggacccuggacuuccacgacagcaacgucaagaaccucuacgagaaggugaagucccagcugaagaacaacgccaaggagaucgggaacggcugcuucgaguucuaccacaagugcaacgacgagugcauggagagcgugaagaacgggacguacgacuaccccaaguacuccgaggagucgaagcugaaccgcgagaagaucgacggcgucaagcucgaguccaugggcguguaccagauccuggccaucuacagcaccguggccagcucccugguccuccuggugagccugggggccaucuccuucuggaugugcagcaacggcucccuccagugccggaucugcaucuga

SEQ ID NO: 5768 - RNA, 1698 nt, Artificial Sequence
  derived and/or modified CDS sequence (AUadapt) from InfluenzaA__ADL60341__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccucguucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgugcagaaggcccuguaccacaccgagaucgccuacgucucgguggugagcucccacuacagccggaaguucacgcccgagaucgccaagcgccccaagguccgggaccaggagggccgcaucaacuacuacuggaccauccucgagcccggggacaccaucaucuucgaggcgaacggcaaccugaucgccccgcgguacgccuucgcccugucccgcggguucggcagcggcaucaucaacuccaacgcccccauggacaagugcgacgcgaagugccagacgccccagggggccaucaacagcucccuccccuuccagaacgugcacccggugaccaucggcgagugccccaaguacguccggucggccaagcugcgcauggugaccgggcugcggaacauccccuccauccagagccgcggccucuucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggucaacagcgugaucgagaagaugaacacccaguucaccgccgucgggaaggaguucaacaagcuggagcggcgcauggagaaccugaacaagaagguggacgacggcuucaucgacaucuggaccuacaacgccgagcuccuggugcugcucgagaacgagcggacgcuggacuuccacgacagcaacgucaagaaccuguacgagaaggugaagucccagcucaagaacaacgcgaaggagaucgggaacggcugcuucgaguucuaccacaagugcaacgacgagugcauggagagcgugaagaacgggaccuacgacuaccccaaguacuccgaggagucgaagcugaaccgcgagaagaucgacggcgucaagcuggaguccaugggcguguaccagauccucgccaucuacagcaccguggccagcucccugguccugcucgugagccugggggccaucuccuucuggaugugcagcaacggcucccugcagugccggaucugcaucuga

SEQ ID NO: 5769 - RNA, 1698 nt, Artificial Sequence
  derived and/or modified CDS sequence (AUadapt) from InfluenzaA__ADL60352__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccggguacgaggagcugcgcgagcagcucuccagcguguccagcuucgagcgguucgagaucuucccgaaggaguccucguggcccaaccacacggucaccggcguguccgccagcugcucccacaacggggagcgcagcuucuaccggaaccugcuguggcucaccggcaagaacgggcuguaccccaaccuguccaagucguacgccaacaacaaggagaaggaggugcucguccuguggggcgugcaccacccgcccgacaucggcaaccagaagacccuguaccacacggagaacgccuacguguccgucgugagcagccacuacucccgcaaguucacccccgagaucgccaagcggcccaaggugcgcgaccaggaggggcggaucaacuacuacuggacccuccuggagcccggcgacaccaucaucuucgaggccaacgggaaccugaucgcgccgcgcuacgccuucgcccucucgcggggcuucggcuccgggaucaucaacagcaacgcccccauggacaagugcgacgccaagugccagacgccccagggcgcgaucaacuccagccugcccuuccagaacguccacccggugaccaucggggagugccccaaguacgugcgcuccgccaagcugcggauggucaccggccuccgcaacauccccucgauccagucccgggggcuguucggcgccaucgccggcuucaucgagggcggcuggaccgggaugguggacggcugguacggguaccaccaccagaacgagcagggcagcggcuacgccgcggaccagaaguccacgcagaacgccaucaacgggaucaccaacaaggugaacagcgucaucgagaagaugaacacccaguucaccgccgugggcaaggaguucaacaagcuggagcgccggauggagaaccucaacaagaaggucgacgacggguucaucgacaucuggacguacaacgccgagcugcuggugcuccuggagaacgagcgcacccuggacuuccacgacuccaacgugaagaaccucuacgagaaggucaagucgcagcugaagaacaacgccaaggagaucggcaacgggugcuucgaguucuaccacaagugcaacgacgagugcauggaguccgugaagaacggcaccuacgacuaccccaaguacagcgaggaguccaagcugaaccgggagaagaucgacggcgugaagcucgagagcaugggggucuaccagauccuggcgaucuacuccaccguggccucgagccuggugcuccuggucucccugggcgccaucagcuucuggaugugcuccaacgggagccuccagugccgcaucugcaucuga

SEQ ID NO: 5770 - RNA, 1701 nt, Artificial Sequence
  derived and/or modified CDS sequence (AUadapt) from InfluenzaA__ADL60363__HA
augaagaccaucaucgcccugucguacauccucugccugguguucgcccagaaguuccccggcaacgacaacuccaccgcgacgcugugccucgggcaccacgccgucccgaacggcaccaucgugaagaccaucaccaacgaccagaucgaggugacgaacgccaccgagcugguccagagcuccucgaccggggagaucugcgacagcccccaccagauccuggacggcgagaacugcacccucaucgacgcccugcugggggacccccagugcgacggcuuccagaacaagaacugggaccucuucguggagcgcucgaaggccuacuccaacugcuaccccuacgacgugccggacuacgcgagccugcggucccugaucgccucguccggcacgcucgaguucaacaacgagagcuucaacuggaccggggucacccagaacggcaccuccucggccugcauccgccgguccaacaacagcuucuucucccgccugaacuggcugacgcacucgaaguucaaguaccccgcccucaacgugaccaugcccaacaacgagaacuucgacaagcuguacaucuggggcgugcaccaccccgggaccgacaacgaccagaucuuccuguacgcgcaggccuccgggcggaucaccaucagcacgaagcgcucgcagcagaccgucaucccgaacaucggcucccggccccgcgugcgggacauccccagccgcaucuccaucuacuggaccaucgugaagcccggcgacauccuccugaucaacucgaccgggaaccugaucgccccgcggggcuacuucaagauccgcuccgggaaguccuccaucaugcggagcgacgcccccaucggcaagugcaacuccgagugcaucacgcccaacggcucgauccccaacgacaagccguuccagaacgucaaccgcaucaccuacggggccugcccccgguacgugaagcagaacacccucaagcuggcgaccggcaugcgcaacgugcccgagaagcagacgcgggggaucuucggcgccaucgccggguucaucgagaacggcugggagggcauggucgacgggugguacggcuuccgccaccagaacuccgagggggugggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccuggagaaguacgucgaggacaccaagaucgaccucuggucguacaacgccgagcugcugguggcccucgagaaccagcacacgaucgaccugaccgacuccgagaugaacaagcuguucgagaagaccaagaagcagcuccgggagaacgccgaggacauggggaacggcugcuucaagaucuaccacaagugcgacaacgcgugcaucgggagcauccgcaacggcaccuacgaccacgacguguaccgcgacgaggcccugaacaaccgguuccagaucaagggggucgagcugaaguccggcuacaaggacuggauccucuggaucagcuucgccaucuccugcuuccugcugugcaucgcccuccugggcuucaucaugugggccugccagaaggggaacauccgcugcaacaucugcaucuga

SEQ ID NO: 5771 - RNA, 1698 nt, Artificial Sequence
  derived and/or modified CDS sequence (AUadapt) from InfluenzaA__ADL60374__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccucgugcucccacgacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugucggucgugagcucccacuacagccggaaguucacgcccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacaagugcgacgcgaagugccagacgccccagggggccaucaacucgucccugcccuuccagaacguccacccggugaccaucggcgagugccccaaguacgugcggagcgccaagcugcgcgucgugaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggucaacucggugaucgagaagaugaacacccaguucaccgccgucgggaaggaguucaacaagcuggagcggcgcauggagaaccucaacaagaagguggacgacggcuucaucgacaucuggaccuacaacgccgagcugcuggugcuccuggagaacgagcggacgcuggacuuccacgacagcaacgucaagaaccucuacgagaaggugaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgucaagcucgaguccaugggcguguaccagauccuggccaucuacucgaccguggccagcucccugguccuccuggugagccugggggccaucuccuucuggaugugcagcaacggcucccuccagugccggaucugcaucuga

SEQ ID NO: 5772 - RNA, 1701 nt, Artificial Sequence
  derived and/or modified CDS sequence (AUadapt) from InfluenzaA__ADM07135__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgagagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 5773 - RNA, 1701 nt, Artificial Sequence; identical to SEQ ID NO: 3399
  derived and/or modified CDS sequence (AUadapt) from InfluenzaA__ADM07144__HA

SEQ ID NO: 5774 - RNA, 1701 nt, Artificial Sequence
  derived and/or modified CDS sequence (AUadapt) from InfluenzaA__ADM07154__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccacccgcccaccagcgccgaccagcagucccuguaccagaacgccgacgccuacguguucgugggcacgucgcgguacuccaagaaguucaagcccgagaucgccauccgccccaagguccgggaccaggagggccgcaugaacuacuacuggacccugguggagcccggggacaagaucaccuucgaggcgaccggcaaccucguggucccccgguacgccuucgccauggugcgcaacgccgggagcggcaucaucaucuccgacacgccggugcacgacugcaacacgaccugccagacccccaagggcgccaucaacaccucgcugcccuuccagaacauccaccccaucaccaucgggaagugcccgaaguacgucaaguccaccaagcugcggcucgcgaccggccugcgcaacgugcccagcauccagucccgggggcuguucggcgccaucgccggguucaucgagggcggcuggacggggaugguggacggcugguacggguaccaccaccagaacgagcagggcucgggguacgccgccgaccucaaguccacccagaacgcgaucgacgagaucaccaacaaggucaacagcgugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacuccaacgucaagaaccucuacgagaaggugcgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgucaagcucgaguccacccgcaucuaccagauccuggcgaucuacucgaccguggccuccagccuggugcucgucgugucgcugggggccaucuccuucuggaugugcagcaacggcucccugcagugccggaucugcaucuga

SEQ ID NO: 5775 - RNA, 1701 nt, Artificial Sequence; identical to SEQ ID NO: 3399
  derived and/or modified CDS sequence (AUadapt) from InfluenzaA__ADM07163__HA

SEQ ID NO: 5776 - RNA, 1698 nt, Artificial Sequence; identical to SEQ ID NO: 5758
  derived and/or modified CDS sequence (AUadapt) from InfluenzaA__ADM07460__HA

SEQ ID NO: 5777 - RNA, 1701 nt, Artificial Sequence
  derived and/or modified CDS sequence (AUadapt) from InfluenzaA__ADM07504__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccucguccggcacgcuggaguucaacaacgagagcuucaacuggaccggggugacccagaacggcaccuccucggccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccucggggcggaucaccguguccacgaagcgcucgcagcaggccgugaucccgaacaucggcagccggccccgcguccggaacauccccucccgcaucucgaucuacuggaccaucgugaagcccggcgacauccugcucaucaacuccaccgggaaccugaucgccccgcggggcuacuucaagauccgcaacgggaaguccuccaucaugcggagcgacgcccccaucggcaagugcaacuccgagugcaucacccccaacggcucgauccccaacgacaagccguuccagaacgugaaccgcaucacguacggggcgugcccccgguacgucaagcagaacacccugaagcucgccaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgcggaccucaagucgacgcaggccgccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacaccaucgaccucacggacuccgagaugaacaagcuguucgagaagaccaagaagcagcugcgcgagaacgcggaggacauggggaacggcugcuucaagaucuaccacaagugcgacaacgccugcaucgggucgauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggcgugccagaaggggaacauccggugcaacaucugcaucuga

SEQ ID NO: 5778 - RNA, 1701 nt, Artificial Sequence
  derived and/or modified CDS sequence (AUadapt) from InfluenzaA__ADM12806__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcaggccgugaucccgaacaucggcagccggccccgcguccggaacauccccucccgcaucucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacccccaacggcuccauccccaacgacaagccguuccagaacgugaaccgcaucacguacggggcgugcccccgguacgucaagcagucgacccugaagcucgccaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgcggaccugaaguccacgcaggccgccaucgaccagaucaacgggaagcugaaccgccucaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacaccaucgaccucacggacuccgagaugaacaagcuguucgagaagaccaagaagcagcugcgcgagaacgcggaggacauggggaacggcugcuucaccaucuaccacaagugcgacaacgccugcaucgggucgauccgcaacggcaccuacgaccacaacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggcgugccagaaggggaacauccggugcaacaucugcaucuga

SEQ ID NO: 5779 - RNA, 1701 nt, Artificial Sequence; identical to SEQ ID NO: 5778
  derived and/or modified CDS sequence (AUadapt) from InfluenzaA__ADM12817__HA

SEQ ID NO: 5780 - RNA, 1701 nt, Artificial Sequence; identical to SEQ ID NO: 5778
  derived and/or modified CDS sequence (AUadapt) from InfluenzaA__ADM12828__HA

SEQ ID NO: 5781 - RNA, 1701 nt, Artificial Sequence; identical to SEQ ID NO: 5778
  derived and/or modified CDS sequence (AUadapt) from InfluenzaA__ADM12839__HA

SEQ ID NO: 5782 - RNA, 1701 nt, Artificial Sequence
  derived and/or modified CDS sequence (AUadapt) from InfluenzaA__ADM12850__HA
augaaggccaucaucgcccugucguacauccucugccugguguucgcgcagaagcugcccggcaacgacaacuccaccgccacccucugccuggggcaccacgccgucccgaacggcacgaucgugaagaccaucaccaacgaccagaucgaggugaccaacgccacggagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggcguacuccaacugcuaccccuacgacgugccggacuacgccucgcugcggucccucgucgccagcuccggcacccuggaguucaacaacgagucguucaacuggacgggggugacccagaacggcaccuccagcgccugcauccgccgguccaacaacucguucuucucccgccugaacuggcucacccaccugaacuucaaguaccccgcgcugaacgugacgaugcccaacaacgagcaguucgacaagcucuacaucuggggcguccaccaccccgggaccgacaaggaccagaucuuccuguacgcccaggccagcgggcggaucaccguguccaccaagcgcucgcagcaggccgugaucccgaacaucggcagccggccccgcguccggaacauccccucccgcaucucgaucuacuggacgaucgugaagcccggcgacauccugcucaucaacuccaccgggaaccugaucgccccgcggggcuacuucaagauccgcagcgggaaguccucgaucaugcgguccgacgcgcccaucggcaagugcaacagcgagugcaucacccccaacggcuccauccccaacgacaagccguuccagaacgugaaccgcaucaccuacggggccugcccccgguacgucaagcagucgacgcugaagcucgccaccggcaugcgcaacgugcccgagaagcagacccgggggaucuucggcgccaucgccggguucaucgagaacggcugggagggcaugguggacgggugguacggcuuccgccaccagaacuccgaggggcggggccaggcggccgaccugaaguccacccaggccgccaucgaccagaucaacgggaagcugaaccgccucaucggcaagacgaacgagaaguuccaccagaucgagaaggaguucuccgaggucgagggccggauccaggaccuggagaaguacguggaggacaccaagaucgaccuguggagcuacaacgccgagcuccugguggcgcuggagaaccagcacaccaucgaccucaccgacuccgagaugaacaagcuguucgagaagacgaagaagcagcugcgcgagaacgccgaggacauggggaacggcugcuucaccaucuaccacaagugcgacaacgccugcaucgggucgauccgcaacggcaccuacgaccacaacgucuaccgggacgaggcccucaacaaccgcuuccagaucaaggggguggagcugaaguccggcuacaaggacuggauccuguggaucagcuucgccaucuccugcuuccuccugugcguggcgcugcucggcuucaucaugugggccugccagaaggggaacauccggugcaacaucugcaucuga

SEQ ID NO: 5783 - RNA, 1701 nt, Artificial Sequence; identical to SEQ ID NO: 116
  derived and/or modified CDS sequence (AUadapt) from InfluenzaA__ADM12861__HA

SEQ ID NO: 5784 - RNA, 1701 nt, Artificial Sequence; identical to SEQ ID NO: 116
  derived and/or modified CDS sequence (AUadapt) from InfluenzaA__ADM12871__HA

SEQ ID NO: 5785 - RNA, 1701 nt, Artificial Sequence; identical to SEQ ID NO: 116
  derived and/or modified CDS sequence (AUadapt) from InfluenzaA__ADM12881__HA

SEQ ID NO: 5786 - RNA, 1701 nt, Artificial Sequence; identical to SEQ ID NO: 116
  derived and/or modified CDS sequence (AUadapt) from InfluenzaA__ADM12891__HA

SEQ ID NO: 5787 - RNA, 1701 nt, Artificial Sequence; identical to SEQ ID NO: 116
  derived and/or modified CDS sequence (AUadapt) from InfluenzaA__ADM12901__HA

SEQ ID NO: 5788 - RNA, 1701 nt, Artificial Sequence; identical to SEQ ID NO: 4016
  derived and/or modified CDS sequence (AUadapt) from InfluenzaA__ADM12911__HA

SEQ ID NO: 5789 - RNA, 1701 nt, Artificial Sequence; identical to SEQ ID NO: 116
  derived and/or modified CDS sequence (AUadapt) from InfluenzaA__ADM12921__HA

SEQ ID NO: 5790 - RNA, 1701 nt, Artificial Sequence; identical to SEQ ID NO: 116
  derived and/or modified CDS sequence (AUadapt) from InfluenzaA__ADM12931__HA

SEQ ID NO: 5791 - RNA, 1701 nt, Artificial Sequence; identical to SEQ ID NO: 116
  derived and/or modified CDS sequence (AUadapt) from InfluenzaA__ADM12941__HA

SEQ ID NO: 5792 - RNA, 1701 nt, Artificial Sequence; identical to SEQ ID NO: 116
  derived and/or modified CDS sequence (AUadapt) from InfluenzaA__ADM12951__HA

SEQ ID NO: 5793 - RNA, 1701 nt, Artificial Sequence
  derived and/or modified CDS sequence (AUadapt) from InfluenzaA__ADM12961__HA
augaaggccgugcuggucgugcuccuguacaccuucgccaccgcgaacgccgacacgcugugcaucggcuaccacgccaacaacucgaccgacaccguggacaccguccucgagaagaacgugacggugacccacuccgucaacauccuggaggacaagcacaacgggaagcugugcaagcucggcgggguggcgccccugcaccugggcaagugcaacaucgccggguggauccucggcaacccggagugcgagucgcuguccaccgccagcuccuggucguacaucguggagaccuccagcuccgacaacggcacgugcuaccccggggacuucaucgacuacgaggagcugcgcgagcagcucucguccgucagcuccuucgagcgguucgagaucuuccccaagaccucguccuggcccaaccacgacagcaacaagggcgugaccgccgccugcccgcacgccggggcgaaguccuucuacaagaaccugaucuggcuggugaagaagggcaacucguaccccaagcucuccaagagcuacaucaacgacaaggggaaggagguccuggugcuguggggcauccaccaccccucgaccuccgccgaccagcagagccucuaccagaacgccgacgccuacguguucgucggcacgucccgcuacucgaagaaguucaagcccgagaucgccauccggccgaaggugcgcgaccaggaggggcggaugaacuacuacuggacccugguggagcccggcgacaagaucaccuucgaggcgaccgggaaccuggucgugccccgcuacgccuucgccauggagcggaacgccggcuccggcaucaucaucagcgacacgcccgugcacgacugcaacacgaccugccagaccccgaagggggccaucaacaccucccuccccuuccagaacauccaccccaucaccaucggcaagugccccaaguacgucaagucgaccaagcugcgccuggcgaccgggcuccggaacgugccguccauccagagccgcggccuguucggggccaucgccggcuucaucgagggcggguggacgggcaugguggacgggugguacggcuaccaccaccagaacgagcagggguccggcuacgccgccgaccucaagucgacccagaacgcgaucgacgagaucaccaacaaggucaacuccgugaucgagaagaugaacacccaguucacggccgucggcaaggaguucaaccaccuggagaagcggaucgagaaccugaacaagaagguggacgacggguuccuggacaucuggaccuacaacgccgagcuccuggugcugcucgagaacgagcgcacccuggacuaccacgacagcaacgucaagaaccuguacgagaaggugcggucccagcucaagaacaacgccaaggagaucggcaacgggugcuucgaguucuaccacaagugcgacaacacgugcauggagucggugaagaacggcaccuacgacuaccccaaguacuccgaggaggccaagcugaaccgcgaggagaucgacggggucaagcuggagagcacccggaucuaccagauccucgcgaucuacuccaccguggccucgagccuggugcuggucgugucccucggcgccaucucguucuggaugugcuccaacggcagccugcagugccgcaucugcaucuga

SEQ ID NO: 5794 - RNA, 1701 nt, Artificial Sequence; identical to SEQ ID NO: 4563
  derived and/or modified CDS sequence (AUadapt) from InfluenzaA__ADM12971__HA

SEQ ID NO: 5795 - RNA, 1701 nt, Artificial Sequence; identical to SEQ ID NO: 4015
  derived and/or modified CDS sequence (AUadapt) from InfluenzaA__ADM12981__HA

SEQ ID NO: 5796 - RNA, 1701 nt, Artificial Sequence
  derived and/or modified CDS sequence (AUadapt) from InfluenzaA__ADM12991__HA
augaaggccauccuggugguccuccuguacaccuucgagaccgccaacgcggacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgccaaguccuucuacaagaaccugaucuggcucgugaagaaggggaacucguaccccaagcuguccaagagcuacaucaacgacaagggcaaggaggugcugguccucugggggauccaccaccccucgaccuccgcggaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggccaccggcaaccucguggucccccgguacgcguucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgccaccggccugcgcaacgugccguccauccagagccgggggcuguucggcgcgaucgccggguucaucgagggcggcuggacggggaugguggacggcugguacggguaccaccaccagaacgagcagggcuccggguacgccgccgaccucaagucgacccagcacgccaucgacgagaucaccaacaaggugaacuccgucaucgagaagaugaacacccaguucacggcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggccaucuacuccaccgucgcgucgagccuggugcucguggucucccugggggccaucucguucuggaugugcuccaacggcagccugcagugccggaucugcaucuga

SEQ ID NO: 5797 - RNA, 1701 nt, Artificial Sequence
  derived and/or modified CDS sequence (AUadapt) from InfluenzaA__ADM13001__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacaucccguccauccagagccgggggcuguucggcgccaucgccggguucaucgagggcggcuggacggggaugguggacggcugguacggguaccaccaccagaacgagcagggcuccggguacgccgccgaccucaagucgacccagcacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgagccugguccucguggugucccugggggccaucucguucuggaugugcuccaacggcagccugcagugccggaucugcaucuga

SEQ ID NO: 5798 - RNA, 1701 nt, Artificial Sequence; identical to SEQ ID NO: 4078
  derived and/or modified CDS sequence (AUadapt) from InfluenzaA__ADM13011__HA

SEQ ID NO: 5799 - RNA, 1701 nt, Artificial Sequence
  derived and/or modified CDS sequence (AUadapt) from InfluenzaA__ADM13021__HA
augaaggccauccuggugguccuccuguacaccuucgccaccgcgaacgccgacacgcugugcaucggcuaccacgccaacaacucgaccgacaccaucgacaccgugcucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagucgcuguccaccgccagcuccuggucguacaucgucgagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggugaccgccgccugcccgcacgccggcgcgaaguccuucuacaagaaccugaucuggcucgucaagaaggggaacucguaccccaagcuguccaagagcuacaucaacgacaagggcaaggaggugcuggugcucugggggauccaccaccccucgaccuccgccgaccagcagagccuguaccagaacgccgacgccuacgucuucgugggcacgucccgguacucgaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgagccugguccucguggugucccugggggccaucucguucuggaugugcuccaacggcagccugcagugccggaucugcaucuga

SEQ ID NO: 5800 - RNA, 1701 nt, Artificial Sequence; identical to SEQ ID NO: 4260
  derived and/or modified CDS sequence (AUadapt) from InfluenzaA__ADM13031__HA

SEQ ID NO: 5801 - RNA, 1701 nt, Artificial Sequence
  derived and/or modified CDS sequence (AUadapt) from InfluenzaA__ADM13041__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacgugcaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggucaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgucaagcucgagagcacccgcaucuaccagauccuggcgaucuacuccaccguggccucgagccuggugcucgucgugucccugggggccaucucguucuggaugugcuccaacggcagccugcagugccggaucugcaucuga

SEQ ID NO: 5802 - RNA, 1701 nt, Artificial Sequence
  derived and/or modified CDS sequence (AUadapt) from InfluenzaA__ADM13051__HA
augaaggccauccuggugguccuccuguacaccuucgccaccacgaacgcggacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagacguccagcuccgacaacgggaccugcuaccccggcgacuucaucgacuacgaggagcuccgggagcagcugucguccgugagcuccuucgagcgcuucgagaucuuccccaagaccucguccuggcccaaccacgacagcaacaagggcgucaccgccgccugcccgcacgccggcgccaaguccuucuacaagaaccugaucuggcucgugaagaaggggaacucguaccccaagcuguccaagagcuacaucaacgacaagggcaaggaggugcugguccucugggggauccaccaccccucgacguccgcggaccagcagagccuguaccagaacgccgacgccuacguguucgugggcaccucccgguacucgaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacaagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggccaucuacuccaccgucgcgucgagccuggugcucguggucucccugggggccaucucguucuggaugugcuccaacggcagccugcagugccggaucugcaucuga

SEQ ID NO: 5803 - RNA, 1701 nt, Artificial Sequence
  derived and/or modified CDS sequence (AUadapt) from InfluenzaA__ADM13061__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcaucgcgccccugcaccucgggaagugcaacaucgccggcuggauccuggggaacccggagugcgagagccuguccaccgccucguccuggagcuacaucgucgagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggugaccgccgccugcccgcacgccggcgcgaaguccuucuacaagaaccugaucuggcucgucaagaaggggaacagcuaccccaagcuguccaagucguacaucaacgacaagggcaaggaggugcuggugcucugggggauccaccaccccagcaccuccgccgaccagcagucgcuguaccagaacgccgacgccuacgucuucgugggcacgucccgguacagcaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucucggacacgcccguccacgacugcaacaccuccugccagaccccgaagggcgccaucaacaccagccugcccuuccagaacauccaccccaucacgaucgggaagugccccaaguacgugaaguccaccaagcugcggcucgcgaccggccugcgcaacgugccgucgauccagucccgggggcuguucggcgccaucgccggguucaucgagggcggcuggaccgggauggucgacggcugguacggguaccaccaccagaacgagcagggcagcggguacgccgccgaccucaaguccacgcagaacgcgaucgacgagaucaccaacaaggugaacucggugaucgagaagaugaacacccaguucaccgccgucggcaaggaguucaaccaccuggagaagcgcaucgagaaccugaacaagaagguggacgacggcuuccucgacaucuggacguacaacgccgagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuaccccaaguacucggaggaggccaagcugaaccgggaggagaucgacggcgugaagcucgaguccacccgcaucuaccagauccuggcgaucuacagcaccguggccucgucccugguccucguggugagccugggggccaucuccuucuggaugugcagcaacggcucccugcagugccggaucugcaucuga

SEQ ID NO: 5804 - RNA, 1701 nt, Artificial Sequence; identical to SEQ ID NO: 5081
  derived and/or modified CDS sequence (AUadapt) from InfluenzaA__ADM13071__HA

SEQ ID NO: 5805 - RNA, 1701 nt, Artificial Sequence
  derived and/or modified CDS sequence (AUadapt) from InfluenzaA__ADM13081__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcaucgcgccccugcaccucgggaagugcaacaucgccggcuggauccuggggaacccggagugcgagucgcuguccaccgcgagcuccuggucguacaucgucgagaccuccggcagcgacaacggcacgugcuaccccggggacuucaucgacuacgaggagcuccgggagcagcuguccucgguguccagcuucgagcgcuucgagaucuuccccaagaccuccucguggcccaaccacgacuccaacaagggcgugaccgccgccugcccgcacgccggggccaagagcuucuacaagaaccugaucuggcucgucaagaagggcaacuccuaccccaagcugucgaaguccuacaucaacgacaaggagaaggaggugcuggugcucugggggauccaccaccccagcaccucggccgaccagcagucccuguaccagaacgccgacgccuacgucuucgugggcacgucgcgguacuccaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccgggagcggcaucaucaucuccgacacgcccguccacgacugcaacacgaccugccagaccccgaagggcgccaucaacaccucgcugcccuuccagaacauccaccccaucaccaucgggaagugccccaaguacgugaaguccaccaagcugcggcucgcgaccggccugcgcaacgugccgagcauccagucccgggggcuguucggcgccaucgccggguucaucgagggcggcuggacggggauggucgacggcugguacggguaccaccaccagaacgagcagggcucgggguacgccgccgaccucaaguccacccagaacgcgaucgacgagaucaccaacaaggugaacagcgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcucgcagcugaagaacaacgccaaggagaucgggaacggcugcuucgaguucuaccacaagugcgacaacacgugcauggaguccgucaagaacgggaccuacgacuaccccaaguacagcgaggaggccaagcugaaccgggaggagaucgacggcgugaagcucgaguccacccgcaucuaccagauccuggcgaucuacucgaccguggccuccagccugguccucguggugucgcugggggccaucuccuucuggaugugcagcaacggcucccugcagugccggaucugcaucuga

SEQ ID NO: 5806 - RNA, 1701 nt, Artificial Sequence; identical to SEQ ID NO: 4334
  derived and/or modified CDS sequence (AUadapt) from InfluenzaA__ADM13091__HA

SEQ ID NO: 5807 - RNA, 1701 nt, Artificial Sequence; identical to SEQ ID NO: 4078
  derived and/or modified CDS sequence (AUadapt) from InfluenzaA__ADM13101__HA

SEQ ID NO: 5808 - RNA, 1701 nt, Artificial Sequence
  derived and/or modified CDS sequence (AUadapt) from InfluenzaA__ADM13111__HA
augaaggccauccuggugguccuccuguacaccuucgagaccgccaacgcggacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacagcaacaagggggucaccgccgccugcccgcacgccggcgccaaguccuucuacaagaaccugaucuggcucgugaagaaggggaacucguaccccaagcuguccaagagcuacaucaacgacaagggcaaggaggugcugguccucugggggauccaccaccccucgaccuccgcggaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggaccccggggacaagaucaccuucgaggccaccggcaaccucguggucccccgguacgcguucgccauggagcgcaacgccggguccggcaucaucaucagcgacacgcccgugcacgacugcaacacgaccugccagaccccgaacggcgccaucaacaccucccugcccuuccagaacauccaccccaucaccaucgggaagugccccaaguacgucaagucgaccaagcugcggcucgccaccggccugcgcaacgugccguccauccagagccgggggcuguucggcgcgaucgccggguucaucgagggcggcuggacggggaugguggacggcugguacggguaccaccaccagaacgagcagggcuccggguacgccgccgaccucaagucgacccagaacgccaucgacaagaucaccaacaaggugaacuccgucaucgagaagaugaacacccaguucacggcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggccaucuacuccaccgucgcgucgagccuggugcucguggucucccugggggccaucucguucuggaugugcuccaacggcagccugcagugccggaucugcaucuga

SEQ ID NO: 5809 - RNA, 1701 nt, Artificial Sequence; identical to SEQ ID NO: 116
  derived and/or modified CDS sequence (AUadapt) from InfluenzaA__ADM13121__HA

SEQ ID NO: 5810 - RNA, 1701 nt, Artificial Sequence; identical to SEQ ID NO: 4078
  derived and/or modified CDS sequence (AUadapt) from InfluenzaA__ADM13131__HA

SEQ ID NO: 5811 - RNA, 1701 nt, Artificial Sequence; identical to SEQ ID NO: 4242
  derived and/or modified CDS sequence (AUadapt) from InfluenzaA__ADM13141__HA

SEQ ID NO: 5812 - RNA, 1701 nt, Artificial Sequence; identical to SEQ ID NO: 4242
  derived and/or modified CDS sequence (AUadapt) from InfluenzaA__ADM13151__HA

SEQ ID NO: 5813 - RNA, 1701 nt, Artificial Sequence; identical to SEQ ID NO: 4015
  derived and/or modified CDS sequence (AUadapt) from InfluenzaA__ADM13161__HA

SEQ ID NO: 5814 - RNA, 1701 nt, Artificial Sequence; identical to SEQ ID NO: 4563
  derived and/or modified CDS sequence (AUadapt) from InfluenzaA__ADM13171__HA

SEQ ID NO: 5815 - RNA, 1701 nt, Artificial Sequence; identical to SEQ ID NO: 4563
  derived and/or modified CDS sequence (AUadapt) from InfluenzaA__ADM13181__HA

SEQ ID NO: 5816 - RNA, 1701 nt, Artificial Sequence
  derived and/or modified CDS sequence (AUadapt) from InfluenzaA__ADM13191__HA
augaaggccauccuggugguccuccuguacacccuggccaccgcgaacgccgacacgcucugcaucggcuaccacgccaacaacucgaccgacaccguggacaccgugcuggagaagaacgucacggugacccacuccgugaaccugcucgaggacaagcacaacgggaagcugugcaagcugcgcggcgucgcgccccuccaccuggggaagugcaacaucgccggcuggauccuggggaacccggagugcgagucgcucuccaccgccagcuccuggucguacaucguggagaccuccagcuccgacaacggcacgugcuaccccggcgacuucaucgacuacgaggagcugcgggagcagcugucguccgugagcuccuucgagcgcuucgagaucuuccccaagaccucguccuggcccaaccacgacucgaacaagggggucaccgccgccugcccgcacgccggcgcgaaguccuucuacaagaaccucaucuggcuggugaagaaggggaacagcuaccccaagcuguccaagucguacaucaacgacaagggcaaggaggugcucguccugugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccucguggagcccggggacaagaucaccuucgaggcgaccggcaaccugguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcuccggcuggcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagucgacccagcacgcgaucgacgagaucaccaacaaggugaacuccgucaucgagaagaugaacacccaguucacggccgugggcaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacagcaacgugaagaaccuguacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcucaaccgggaggagaucgacggcgugaagcuggagagcacccgcaucuaccagauccuggcgaucuacuccaccgucgccucgagccucgugcugguggucucccugggggccaucucguucuggaugugcuccaacggcagccuccagugccggaucugcaucuga

SEQ ID NO: 5817 - RNA, 1701 nt, Artificial Sequence
  derived and/or modified CDS sequence (AUadapt) from InfluenzaA__ADM13211__HA
augaaggccauccuggugguccuccuguacacccuggccaccgcgaacgccgacacgcucugcaucggcuaccacgccaacaacucgaccgacaccguggacaccgugcuggagaagaacgucacggugacccacuccgugaaccugcucgaggacaagcacaacgggaagcugugcaagcugcgcggcaucgcgccccuccaccuggggaagugcaacaucgccggcuggauccuggggaacccggagugcgagucgcucuccaccgccagcuccuggucguacaucgucgagaccuccagcuccgacaacggcacgugcuaccccggcgacuucaucgacuacgaggagcugcgggagcagcugucguccgugagcuccuucgagcgcuucgagaucuuccccaagaccucguccuggcccaaccacgacucgaacaagggggugaccgccgccugcccgcacgccggcgcgaaguccuucuacaagaaccucaucuggcuggucaagaaggggaacagcuaccccaagcuguccaagucguacaucaacgacaagggcaaggaggugcucgugcugugggggauccaccaccccagcaccuccgccgaccagcagucgcuguaccagaacgccgacgccuacgucuucgugggcacgucccgguacagcaagaaguucaagcccgagaucgccauccgcccgaaggugcgggaccaggagggccgcaugaacuacuacuggacccucgucgagcccggggacaagaucaccuucgaggcgaccggcaaccugguggugccccgguacgccuucgccauggagcgcaacgccggguccggcaucaucaucucggacacgcccguccacgacugcaacacgaccugccagaccccgaagggcgccaucaacaccucccugcccuuccagaacauccaccccaucaccaucgggaagugccccaaguacgucaagagcaccaagcuccggcuggcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgugaucgagaagaugaacacccaguucacggccgucggcaaggaguucaaccaccuggagaagcgcaucgagaaccucaacaagaagguggacgacggcuuccuggacaucuggaccuacaacgccgagcugcucguccugcuggagaacgagcggacccucgacuaccacgacagcaacgugaagaaccuguacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcucaaccgggaggagaucgacggcgugaagcuggagagcacccgcaucuaccagauccuggcgaucuacuccaccguggccucgagccucguccugguggugucccugggggccaucucguucuggaugugcuccaacggcagccuccagugccggaucugcaucuga

SEQ ID NO: 5818 - RNA, 1701 nt, Artificial Sequence; identical to SEQ ID NO: 5817
  derived and/or modified CDS sequence (AUadapt) from InfluenzaA__ADM13221__HA

SEQ ID NO: 5819 - RNA, 1701 nt, Artificial Sequence
  derived and/or modified CDS sequence (AUadapt) from InfluenzaA__ADM13231__HA
augaaggccauccuggugguccuccuguacaccuucgagaccgccaacgcggacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacagcaacaagggggucaccgccgccugcccgcacgccggcgccaaguccuucuacaagaaccugaucuggcucgugaagaaggggaacucguaccccaagcuguccaagagcuacaucaacgacaagggcaaggaggugcugguccucugggggauccaccaccccucgaccuccgcggaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggccaccggcaaccucguggucccccgguacgcguucgccauggagcgcaacgccggguccggcaucaucaucagcgacacgcccgugcacgacugcaacacgaccugccagaccccgaacggcgccaucaacaccucccugcccuuccagaacauccaccccaucaccaucgggaagugccccaaguacgucaagucgaccaagcugcggcucgccaccggccugcgcaacgugccguccauccagagccgggggcuguucggcgcgaucgccggguucaucgagggcggcuggacggggaugguggacggcugguacggguaccaccaccagaacgagcagggcuccggguacgccgccgaccucaagucgacccagaacgccaucgacaagaucaccaacaaggugaacuccgucaucgagaagaugaacacccaguucacggcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggccaucuacuccaccgucgcgucgagccuggugcucguggucucccugggggccaucucguucuggaugugcuccaacggcagccugcagugccggaucugcaucuga

SEQ ID NO: 5820 - RNA, 1701 nt, Artificial Sequence; identical to SEQ ID NO: 4078
  derived and/or modified CDS sequence (AUadapt) from InfluenzaA__ADM13241__HA

SEQ ID NO: 5821 - RNA, 1701 nt, Artificial Sequence
  derived and/or modified CDS sequence (AUadapt) from InfluenzaA__ADM13251__HA
augaaggccauccuggugguccuccuguacaccuucgccaccacgaacgcggacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagacguccagcuccgacaacgggaccugcuaccccggcgacuucaucgacuacgaggagcuccgggagcagcugucguccgugagcuccuucgagcgcuucgagaucuuccccaagaccucguccuggcccaaccacgacagcaacaagggcgucaccgccgccugcccgcacgccggcgccaaguccuucuacaagaaccugaucuggcucgugaagaaggggaacucguaccccaagcuguccaagagcuacaucaacgacaagggcaaggaggugcugguccucugggggauccaccaccccucgacguccgcggaccagcagagccuguaccagaacgccgacgccuacguguucgugggcaccucccgguacucgaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcgacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacaagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggccaucuacuccaccgucgcgucgagccuggugcucguggucucccugggggccaucucguucuggaugugcuccaacggcagccugcagugccggaucugcaucuga

SEQ ID NO: 5822 - RNA, 1701 nt, Artificial Sequence
  derived and/or modified CDS sequence (AUadapt) from InfluenzaA__ADM13261__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcaucgcgccccugcaccucgggaagugcaacaucgccggcuggauccuggggaacccggagugcgagucgcuguccaccgcgagcuccuggucguacaucgucgagaccuccggcagcgacaacggcacgugcuaccccggggacuucaucgacuacgaggagcuccgggagcagcuguccucgguguccagcuucgagcgcuucgagaucuuccccaagaccuccucguggcccaaccacgacuccaacaagggcgugaccgccgccugcccgcacgccggggccaagagcuucuacaagaaccugaucuggcucgucaagaagggcaacuccuaccccaagcugucgaaguccuacaucaacgacaaggggaaggaggugcuggugcucuggggcauccaccaccccagcaccucggccgaccagcagucccuguaccagaacgccgacgccuacgucuucgugggcacgucgcgguacuccaagaaguucaagcccgagaucgccauccgcccgaaggugcgggaccaggaggggcgcaugaacuacuacuggacccuggucgagcccggcgacaagaucaccuucgaggcgaccgggaaccucguggugccccgguacgccuucgccauggagcgcaacgccggcagcggcaucaucaucuccgacacgcccguccacgacugcaacacgaccugccagaccccgaagggggccaucaacaccucgcugcccuuccagaacauccaccccaucaccaucggcaagugccccaaguacgugaaguccaccaagcugcggcucgcgaccgggcugcgcaacgugccgagcauccagucccggggccuguucggggccaucgccggcuucaucgagggcggguggacgggcauggucgacgggugguacggcuaccaccaccagaacgagcaggggucgggcuacgccgccgaccucaaguccacccagaacgcgaucgacgagaucaccaacaaggugaacagcgugaucgagaagaugaacacccaguucacggccgucggcaaggaguucaaccaccuggagaagcgcaucgagaaccugaacaagaagguggacgacggguuccucgacaucuggaccuacaacgccgagcugcugguccuccuggagaacgagcggacccuggacuaccacgacuccaacgugaagaaccucuacgagaaggugcgcucgcagcugaagaacaacgccaaggagaucggcaacgggugcuucgaguucuaccacaagugcgacaacacgugcauggaguccgucaagaacggcaccuacgacuaccccaaguacagcgaggaggccaagcugaaccgggaggagaucgacggggugaagcucgaguccacccgcaucuaccagauccuggcgaucuacucgaccguggccuccagccugguccucguggugucgcugggcgccaucuccuucuggaugugcagcaacggcucccugcagugccggaucugcaucuga

SEQ ID NO: 5823 - RNA, 1701 nt, Artificial Sequence
  derived and/or modified CDS sequence (AUadapt) from InfluenzaA__ADM13271__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcauccaccagauccuggcgaucuacuccaccgucgccucgagccuggugcucguggucucccugggggccaucucguucuggaugugcuccaacggcagccugcagugccggaucugcaucuga

SEQ ID NO: 5824 - RNA, 1701 nt, Artificial Sequence; identical to SEQ ID NO: 5819
  derived and/or modified CDS sequence (AUadapt) from InfluenzaA__ADM13281__HA

SEQ ID NO: 5825 - RNA, 1701 nt, Artificial Sequence; identical to SEQ ID NO: 4015
  derived and/or modified CDS sequence (AUadapt) from InfluenzaA__ADM13291__HA

SEQ ID NO: 5826 - RNA, 1701 nt, Artificial Sequence
  derived and/or modified CDS sequence (AUadapt) from InfluenzaA__ADM13301__HA
augaaggccauccuggugguccuccuguacaccuucgccaccgcgaacgccgacacgcugugcaucggcuaccacgccaacaacucgaccgacaccguggacaccauccucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagagccuguccaccgccucguccuggagcuacaucgucgagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggugaccgccgccugcccgcacgccggcgcgaaguccuucuacaagaaccugaucuggcucgucaagaaggagaacagcuaccccaagcuguccaagucguacaucaacgacaaggggaaggaggugcuggugcucuggggcauccaccaccccagcaccuccgccgaccagcagucgcuguaccagaacgucgacgccuacguguucguggggacgucccgguacagcaagaaguucaagcccgagaucgccauccgcccgaagguccgggaccaggagggccgcaugaacuacuacuggacccugguggagcccggcgacaagaucaccuucgaggccaccgggaaccucguggucccccgguacgcguucgccauggagcgcaacgccggcuccgggaucaucaucucggacacgcccgugcacgacugcaacacgaccugccagaccccgaagggcgccaucaacaccucccugcccuuccagaacauccaccccaucaccaucggcaagugccccaaguacgucaagagcaccaagcugcggcucgccaccgggcugcgcaacgugccguccauccagucgcggggccuguucggggcgaucgccggcuucaucgagggcggguggacgggcaugguggacgggugguacggcuaccaccaccagaacgagcagggguccggcuacgccgccgaccucaagagcacccagaacgccaucgacgagaucaccaacaaggugaacuccgucaucgagaagaugaacacccaguucacggcgguggggaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagucgacccgcaucuaccagauccuggccaucuacuccaccgucgcgagcucgcuggugcucguggucucccugggcgccaucagcuucuggaugugcuccaacgggagccugcagugccggaucugcaucuga

SEQ ID NO: 5827 - RNA, 1701 nt, Artificial Sequence
  derived and/or modified CDS sequence (AUadapt) from InfluenzaA__ADM13311__HA
augaaggccauccuggugguccuccuguacaccuucgccaccgcgaacgccgacacgcugugcaucggcuaccacgccaacaacucgaccgacaccguggacaccauccucgagaagaacgugacggucacccacuccgugaaccugcuggagaacaagcacaacgggaagcucugcaagcugcgcggcgugucgccccugcaccucgggaagugcaacaucgccggcuggauccuggggaacccggagugcgagucccugagcaccgccuccucgugguccuacaucgucgagaccagcuccucggacaacggcacgugcuaccccggcgacuucaucgacuacgaggagcuccgggagcagcuguccagcguguccucguucgagcgcuucgagaucuuccccaagaccuccagcuggcccaaccacgacuccaacaagggggugaccgcggccugcccgcacgccggcgccaagucguucuacaagaaccugaucuggcucgucaagaaggggaacuccuaccccaagcugagcaagucguacaucaacgacaagggcaaggaggugcuggugcucugggggauccaccaccccuccaccagcgcggaccagcagucccuguaccagaacgccgacgccuacgucuucgugggcacgucgcgguacuccaagaaguucaagcccgagaucgccauccgcccgaaggugcgggaccaggagggccgcaugaacuacuacuggacccuggucgagcccggggacaagaucaccuucgaggccaccggcaaccucguggugccccgguacgcguucgccauggagcgcaacgccgggagcggcaucaucaucuccgacacgcccguccacgacugcaacacgaccugccagaccccgaagggcgccaucaacaccucgcugcccuuccagaacauccaccccaucaccaucgggaagugccccaaguacgugaaguccaccaagcugcggcucgccaccggccugcgcaacgugccgagcauccagucccgggggcuguucggcgcgaucgccggguucaucgagggcggcuggacggggauggucgacggcugguacggguaccaccaccagaacgagcagggcucgggguacgccgccgaccucaaguccacccagaacgccaucgacgagaucaccaacaaggugaacagcgugaucgagaagaugaacacccaguucacggcggucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcucgcagcugaagaacaacgccaaggagaucgggaacggcugcuucgaguucuaccacaagugcgacaacacgugcauggaguccgucaagaacgggaccuacgacuaccccaaguacagcgaggaggccaagcugaaccgggaggagaucgacggcgugaagcucgaguccacccgcaucuaccagauccuggccaucuacucgaccgcggccagcucccuggugcucgucgugucgcugggggccaucuccuucuggaugugcagcaacggcucccugcagugccggaucugcaucuga

SEQ ID NO: 5828 - RNA, 1701 nt, Artificial Sequence; identical to SEQ ID NO: 4078
  derived and/or modified CDS sequence (AUadapt) from InfluenzaA__ADM13321__HA

SEQ ID NO: 5829 - RNA, 1701 nt, Artificial Sequence; identical to SEQ ID NO: 88
  derived and/or modified CDS sequence (AUadapt) from InfluenzaA__ADM13331__HA

SEQ ID NO: 5830 - RNA, 1701 nt, Artificial Sequence; identical to SEQ ID NO: 4527
  derived and/or modified CDS sequence (AUadapt) from InfluenzaA__ADM13341__HA

SEQ ID NO: 5831 - RNA, 1701 nt, Artificial Sequence; identical to SEQ ID NO: 5493
  derived and/or modified CDS sequence (AUadapt) from InfluenzaA__ADM13351__HA

SEQ ID NO: 5832 - RNA, 1701 nt, Artificial Sequence; identical to SEQ ID NO: 141
  derived and/or modified CDS sequence (AUadapt) from InfluenzaA__ADM13442__HA

SEQ ID NO: 5833 - RNA, 1701 nt, Artificial Sequence; identical to SEQ ID NO: 141
  derived and/or modified CDS sequence (AUadapt) from InfluenzaA__ADM13443__HA

SEQ ID NO: 5834 - RNA, 1701 nt, Artificial Sequence; identical to SEQ ID NO: 141
  derived and/or modified CDS sequence (AUadapt) from InfluenzaA__ADM13444__HA

SEQ ID NO: 5835 - RNA, 1701 nt, Artificial Sequence; identical to SEQ ID NO: 3521
  derived and/or modified CDS sequence (AUadapt) from InfluenzaA__ADM13445__HA

SEQ ID NO: 5836 - RNA, 1701 nt, Artificial Sequence; identical to SEQ ID NO: 141
  derived and/or modified CDS sequence (AUadapt) from InfluenzaA__ADM13446__HA

SEQ ID NO: 5837 - RNA, 1701 nt, Artificial Sequence
  derived and/or modified CDS sequence (AUadapt) from InfluenzaA__ADM13447__HA
augaagaccaucaucgcccugucguacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagagcuccucgaccggcaagaucugcaacaacccccaccgcauccuggacgggaucgacugcacccugaucgacgcccuccugggcgacccccacugcgacgucuuccagaacgagacgugggaccuguucguggagcgguccaaggccuucagcaacugcuaccccuacgacgugccggacuacgcgucccuccgcucgcuggucgccuccagcggcacccuggaguucaucaccgagggguucaccuggacgggcgugacccagaacgggggcuccaacgccugcaagcgggggcccggcucgggcuucuucucccgccucaacuggcugaccaagagcggguccaccuacucggugcugaacgucacgaugcccaacaacgacaacuucgacaagcucuacaucuggggcgugcaccaccccuccaccaaccaggagcagaccagccuguacgugcaggccuccgggcgggucaccgugucgacgcgccggagccagcagaccaucaucccgaacaucggcucccgccccugggugcggggccugucgucccgcaucagcaucuacuggaccaucgucaagcccggggacgugcucgugaucaacuccaacggcaaccugaucgcgccccggggguacuucaagaugcgcaccggcaagucguccaucaugcggagcgacgccccgaucgacacgugcaucuccgagugcaucacccccaacgggucgauccccaacgacaagcccuuccagaacgucaacaagaucaccuacggcgccugcccgaaguacgugaagcagaacacccugaagcucgccacgggcaugcgcaacgugcccgagaagcagacccgggggcuguucggcgccaucgcgggguucaucgagaacggcugggaggggaugaucgacggcugguacggcuuccgccaccagaacuccgaggggaccggccaggccgccgaccucaagagcacccaggccgccaucgaccagaucaacgggaagcugaaccgggucaucgagaagacgaacgagaaguuccaccagaucgagaaggaguucuccgagguggagggccgcauccaggaccuggagaaguacguggaggacaccaagaucgaccuguggucguacaacgcggagcuccuggucgcccuggagaaccagcacaccaucgaccucaccgacuccgagaugaacaagcuguucgagaagacgcggcgccagcugcgggagaacgccgaggacauggggaacggcugcuucaagaucuaccacaagugcgacaacgccugcaucgagagcauccgcaacggcaccuacgaccacgacguguaccgcgacgaggcccucaacaaccgguuccagaucaagggggucgagcugaaguccggcuacaaggacuggauccuguggaucagcuucgcgaucuccugcuuccuccugugcguggugcugcucggguucaucaugugggccugccagcgcggcaacauccggugcaacaucugcaucuga

SEQ ID NO: 5838 - RNA, 1701 nt, Artificial Sequence; identical to SEQ ID NO: 2644
  derived and/or modified CDS sequence (AUadapt) from InfluenzaA__ADM13448__HA

SEQ ID NO: 5839 - RNA, 1701 nt, Artificial Sequence
  derived and/or modified CDS sequence (AUadapt) from InfluenzaA__ADM13449__HA
augaagaccaucaucgcccugucguacaucuucugccucgccuucggccaggaccugcccgggaacgacaacuccaccgcgacgcugugccucggccaccacgccgugccgaacgggacccuggucaagaccaucaccgacgaccagaucgaggugacgaacgccaccgagcuggugcagagcuccucgaccggcaagaucugcaacaacccccaccgcauccucgacgggaucgacugcacccugaucgacgcccugcucggcgacccccacugcgacgucuuccagaacgagacgugggaccuguucguggagcgguccaaggccuucagcaacugcuaccccuacgacgugccggacuacgcgucccugcgcucgcucgucgccuccagcggcacccuggaguucaucaccgagggguucaccuggacgggcgugacccagaacgggggcuccaacgccugcaagcgggggcccggcucgggcuucuucucccgccugaacuggcucaccaagagcggguccaccuaccccgugcugaacgucacgaugcccaacaacgacaacuucgacaagcuguacaucuggggcgugcaccacccgucgaccaaccaggagcagaccucccucuacgugcaggccagcgggcgggucaccguguccacgcgccggucgcagcagaccaucauccccaacaucgagagccgccccugggugcggggccuguccucgcgcaucuccaucuacuggaccaucgucaaccccggcgacgugcuggugaucaacagcaacgggaaccucaucgcgccgcggggcuacuucaagaugcgcaccgggaaguccucgaucaugcgguccgacgcccccaucgacacgugcaucagcgagugcaucacccccaacggcuccauccccaacgacaagccguuccagaacgucaacaagaucaccuacggggccugccccaaguacgugaagcagaacacccugaagcuggccacgggcaugcgcaacgugcccgagaagcagacccggggccucuucggggccaucgcgggcuucaucgagaacgggugggagggcaugaucgacgggugguacggcuuccgccaccagaacucggagggcaccgggcaggccgccgaccugaaguccacccaggccgccaucgaccagaucaacggcaagcugaaccgggucaucgagaagacgaacgagaaguuccaccagaucgagaaggaguucagcgagguggaggggcgcauccaggaccucgagaaguacguggaggacaccaagaucgaccugugguccuacaacgcggagcugcucgucgcccuggagaaccagcacaccaucgaccugaccgacucggagaugaacaagcuguucgagaagacgcggcgccagcuccgggagaacgccgaggacaugggcaacgggugcuucaagaucuaccacaagugcgacaacgccugcaucgaguccauccgcaacggcaccuacgaccacgacguguaccgcgacgaggcccugaacaaccgguuccagaucaagggcgucgagcucaagagcggguacaaggacuggauccuguggaucuccuucgcgaucagcugcuuccugcucugcguggugcugcugggcuucaucaugugggccugccagcgcgggaacauccggugcaacaucugcaucuga

SEQ ID NO: 5840 - RNA, 1701 nt, Artificial Sequence; identical to SEQ ID NO: 2676
  derived and/or modified CDS sequence (AUadapt) from InfluenzaA__ADM13450__HA

SEQ ID NO: 5841 - RNA, 1701 nt, Artificial Sequence
  derived and/or modified CDS sequence (AUadapt) from InfluenzaA__ADM13451__HA
augaagaccaucaucgcccugucguacaucuucugccucgcccugggccaggaccugcccgggaacgacaaccgcaccgcgacgcucugccugggccaccacgccgugccgaacgggacccuggucaagaccaucaccgacgaccagaucgaggugacgaacgccaccgagcucgugcaguccucguccaccggcaagaucugcaacaacccccaccggauccuggacgggaucgacugcacccugaucgacgcccuccugggcgacccccacugcgacgucuuccagaacgagacgugggaccuguucguggagcgcagcaaggccuucuccaacugcuaccccuacgacgugccggacuacgcgucgcuccggucccuggucgccagcuccggcacccuggaguucaucaccgagggguucaccuggacgggcgugacccagaacgggggcucgaacgccugcaagcgcgggcccggcuccggcuucuucagccggcucaacuggcugaccaaguccgggucgaccuaccccgugcugaacgucacgaugcccaacaacgacaacuucgacaagcucuacaucuggggcgugcaccacccguccaccaaccaggagcagaccagccuguacgugcaggccuccgggcgcgucaccgugucgacgcggcgcucccagcagaccaucauccccaacaucggcucgcggcccugggugcgcggccugagcucccggaucucgaucuacuggaccaucgucaagcccggggacgugcucgugaucaacuccaacggcaaccugaucgcgccgcgcggguacuucaagaugcggaccggcaagagcuccaucaugcgcucggacgcccccaucgacacgugcaucuccgagugcaucacccccaacgggagcauccccaacgacaagccguuccagaacgucaacaagaucaccuacggcgccugccccaaguacgugaagcagaacacccugaagcucgccacgggcaugcggaacgugcccgagaagcagacccgcgggcuguucggcgccaucgcgggguucaucgagaacggcugggaggggaugaucgacggcugguacggcuuccggcaccagaacuccgaggggaccggccaggccgccgaccucaagucgacccaggccacgaucgaccagaucaacgggaagcugaaccgcgucaucgagaagaccaacgagaaguuccaccagaucgagaaggaguucuccgagguggagggccggauccaggaccuggagaaguacguggaggacaccaagaucgaccuguggagcuacaacgccgagcuccuggucgcgcuggagaaccagcacaccaucgaccucacggacuccgagaugaacaagcuguucgagaagacccgccggcagcugcgcgagaacgccgaggacauggggaacggcugcuucaagaucuaccacaagugcgacaacgccugcaucgagucgauccgcaacggcaccuacgaccacgacguguaccgggacgaggcccucaacaaccgcuuccagaucaagggggucgagcugaaguccggcuacaaggacuggauccuguggaucagcuucgccaucuccugcuuccuccugugcguggugcugcucggguucaucaugugggcgugccagcggggcaacauccgcugcaacaucugcaucuga

SEQ ID NO: 5842 - RNA, 1701 nt, Artificial Sequence; identical to SEQ ID NO: 2561
  derived and/or modified CDS sequence (AUadapt) from InfluenzaA__ADM13452__HA

SEQ ID NO: 5843 - RNA, 1701 nt, Artificial Sequence
  derived and/or modified CDS sequence (AUadapt) from InfluenzaA__ADM14467__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcucccacgccggcgccaagagcuucuacaagaaccugaucuggcucgugaagaaggggaacuccuacccgaagcugucgaagagcuacaucaacgacaagggcaaggaggugcugguccucugggggauccaccaccccuccaccagcgccgaccagcagucccuguaccagaacgccgacgccuacguguucgugggcacgucgcgguacuccaagaaguucaagcccgagaucgccauccgccccaagguccgggaccaggagggccgcaugaacuacuacuggacccugguggagccgggggacaagaucaccuucgaggcgaccggcaaccucguggucccccgguacgccuucgccauggagcgcaacgccgggagcggcaucaucaucuccgacacgcccgugcacgacugcaacacgaccugccagacccccaagggcgccaucaacaccucgcugccguuccaguccauccaccccaucaccaucgggaagugccccaaguacgucaagagcaccaagcugcggcucgcgaccggccugcgcaacgugcccuccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacacgugcauggagagcgugaagaacgggaccuacgacuacccgaaguacuccgaggaggccaagcugaaccgggaggagaucgacggcgugaagcucgagucgacccgcaucuaccagauccuggcgaucuacagcaccgucgccuccucgcuggugcucguggucucccugggggccaucagcuucuggaugugcuccaacggcagccugcagugccggaucugcaucuga

SEQ ID NO: 5844 - RNA, 1695 nt, Artificial Sequence
  derived and/or modified CDS sequence (AUadapt) from InfluenzaA__ADM14516__HA
augaaggccauccuggugguccuccuguacaccuucgccaccgcgaacgccgacacgcugugcaucggcuaccacgccaacaacucgaccgacaccgugaacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccacggaccagcagucgcuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucucggacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagucgcgggggcuguucggcgcgaucgccggguucaucgagggcggcuggaccgggaugguggacggcugguacggguaccaccaccagaacgagcagggcuccggguacgccgccgaccucaagucgacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggccaucuacuccaccgucgcgucgagccuggugcucguggucucccugggggccaucucguucuggaugugcuccggccacagcugccggaucugcaucuga

SEQ ID NO: 5845 - RNA, 1701 nt, Artificial Sequence
  derived and/or modified CDS sequence (AUadapt) from InfluenzaA__ADM14525__HA
augaaggccacccuggugguccuccuguacaccuucgccacggcgaacgccgacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagacguccagcuccgacaacgggaccugcuaccccggcgacuucaucgacuacgaggagcuccgggagcagcugucgucccugagcuccuucgagcgcuucgagaucuuccccaagaccucguccuggcccaaccacgacucgaacaagggggugaccgccgccugcccgcacgccggcgcgaaguccuucuacaagaaccucaucuggcuggucaagaaggggaacagcuaccccaagcuguccaagucguacaucaacgacaagggcaaggacgugcucgugcugugggggauccaccaccccagcacguccgccgaccagcagucgcuguaccagaacgccgacgccuacgucuucgugggcaccucccgguacagcaagaaguucaagcccgagaucgccauccgcccgaaggugcgggaccaggagggccgcaugaacuacuacuggacccucgucgagcccggggacaagaucaccuucgaggcgacgggcaaccugguggugccccgguacgccuucgccauggagcgcaacgccggguccggcaucaucaucucggacacccccguccacgacugcaacacgaccugccagaccccgaagggcgccaucaacaccucccugcccuuccagaacauccaccccaucaccaucgggaagugccccaaguacgucaagagcaccaagcuccggcuggcgacgggccugcgcaacgugccguccauccagucgcggggccucuucggcgccaucgccggguucaucgagggcggcuggaccgggaugguggacggcugguacggguaccaccaccagaacgagcagggcuccggguacgccgccgaccucaagucgacccagaacgcgaucgacgagaucaccaacaaggugaacuccgugaucgagaagaugaacacgcaguucaccgccgucggcaaggaguucaaccaccuggagaagcgcaucgagaaccugaacaagaagguggacgacggcuuccuggacaucuggaccuacaacgccgagcugcucguccugcuggagaacgagcggacccucgacuaccacgacagcaacgugaagaaccuguacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcucaaccgggaggagaucgacggcgugaagcuggagagcacccgcaucuaccagauccuggcgaucuacuccaccguggccucgagccucguccugguggugucccugggggccaucucguucuggaugugcuccaacggcagccuccagugccggaucugcaucuga

SEQ ID NO: 5846 - RNA, 1695 nt, Artificial Sequence
  derived and/or modified CDS sequence (AUadapt) from InfluenzaA__ADM14553__HA
augaaggccauccuggugguccuccuguacaccuucgccaccgcgaacgccgacacgcugugcaucggcuaccacgccaacaacucgaccgacaccguggacaccauccucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagucgcuguccaccgccagcuccuggucguacaucgucgagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggugaccgccgccugcccgcacgccggcgcgaaguccuucuacaagaaccugaucuggcucgucaagaaggggaacucguaccccaagcuguccaagagcuacaucaacgacaagggcaaggaggugcuggugcucugggggauccaccaccccucgaccuccgccgaccagcagagccuguaccagaacgccgacgccuacgucuucguggagacgucccgguacucgaagaaguucaagcccgagaucgccauccgcccgaaggugcgggaccaggagggccgcaugaacuacuacuggacccuggucgagcccggcgacaagaucaccuucgaggcgaccgggaaccucguggugccccgguacgccuucgccauggagcgcaacgccggcuccgggaucaucaucagcgacacguccguccacgacugcaacacgaccugccagacccccaagggcgccaucaacaccucgcugccguuccagaacauccaccccaucaccaucggcaagugccccaaguacgugaaguccaccaagcugcggcucgcgaccgggcugcgcaacgugcccagcauccagucccggggccuguucggggccaucgccggcuucaucgagggcggguggacgggcauggucgacgggugguacggcuaccaccaccagaacgagcaggggucgggcuacgccgccgaccucaaguccacccagaacgcgaucgacgagaucaccaacaaggugaacagcgugaucgagaagaugaacacccaguucacggccgucgggaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcucgcagcugaagaacaacgccaaggagaucggcaacgggugcuucgaguucuaccacaagugcgacaacacgugcauggaguccgucaagaacggcaccuacgacuacccgaaguacagcgaggaggccaagcugaaccgggaggagaucgacggggugaagcucgaguccacccgcaucuaccagauccuggcgaucuacucgaccguggccagcucccugguccucguggugucgcugggcgccaucuccuucuggaugugcagcgggcacuccugccggaucugcaucuga

SEQ ID NO: 5847 - RNA, 1701 nt, Artificial Sequence; identical to SEQ ID NO: 3361
  derived and/or modified CDS sequence (AUadapt) from InfluenzaA__ADM14562__HA

SEQ ID NO: 5848 - RNA, 1701 nt, Artificial Sequence; identical to SEQ ID NO: 116
  derived and/or modified CDS sequence (AUadapt) from InfluenzaA__ADM14571__HA

SEQ ID NO: 5849 - RNA, 1701 nt, Artificial Sequence
  derived and/or modified CDS sequence (AUadapt) from InfluenzaA__ADM14580__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagaagaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucaacggcgugaagcucgagagcacccggaucuaccagauccuggcgaucuacuccaccgucgccucgagccuggugcucguggucucccugggggccaucucguucuggaugugcuccaacggcagccugcagugccgcaucugcaucuga

SEQ ID NO: 5850 - RNA, 1701 nt, Artificial Sequence
  derived and/or modified CDS sequence (AUadapt) from InfluenzaA__ADM14589__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagaagaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcgccucgcgaccggccugcggaacgugccguccauccagagccgcgggcuguucggcgccaucgccggguucaucgagggcggcuggacggggaugguggacggcugguacggguaccaccaccagaacggccagggguccggcuacgccgccgaccucaagucgacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggguuccucgacaucuggaccuacaacgccgagcugcuggugcuccuggagaacgagcgcacccuggacuaccacgacagcaacgugaagaaccucuacgagaagguccggucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgcgaggagaucaacggggugaagcucgagagcacccggaucuaccagauccuggcgaucuacuccaccgucgccucgagccuggugcucguggucucccugggcgccaucucguucuggaugugcuccaacggcagccugcagugccgcaucugcaucuga

SEQ ID NO: 5851 - RNA, 1701 nt, Artificial Sequence
  derived and/or modified CDS sequence (AUadapt) from InfluenzaA__ADM14599__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgucauccgcccgaaggugcgggaccaggagggccgcaugaacuacuacuggacccugguggagcccggggacaagaucaccuucgaggccaccggcaaccucgucgugccccgguacgcguucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgccaccggccugcgcaacgugccguccauccagucgcgggggcuguucggcgcgaucgccggguucaucgagggcggcuggacggggaugguggacggcugguacggguaccaccaccagaacgagcagggcuccggguacgccgccgaccucaagagcacccagaacgccaucgacgagaucaccaacaaggucaacuccgugaucgagaagaugaacacccaguucacggcggucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacucgaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagucgacccgcaucuaccagauccuggccaucuacuccaccguggcgagcucgcuggugcucgucgugucccugggggccaucagcuucuggaugugcuccaacggcagccugcagugccggaucugcaucuga

SEQ ID NO: 5852 - RNA, 1701 nt, Artificial Sequence; identical to SEQ ID NO: 4074
  derived and/or modified CDS sequence (AUadapt) from InfluenzaA__ADM14609__HA

SEQ ID NO: 5853 - RNA, 1701 nt, Artificial Sequence
  derived and/or modified CDS sequence (AUadapt) from InfluenzaA__ADM14618__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacaaccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 5854 - RNA, 1701 nt, Artificial Sequence; identical to SEQ ID NO: 116
  derived and/or modified CDS sequence (AUadapt) from InfluenzaA__ADM14627__HA

SEQ ID NO: 5855 - RNA, 1701 nt, Artificial Sequence
  derived and/or modified CDS sequence (AUadapt) from InfluenzaA__ADM14655__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgugcggucgaccaagcugcgccucgcgaccggccugcggaacgucccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggcgaucuacuccaccgucgccucgagccuggugcucguggucucccugggggccaucucguucuggaugugcuccaacggcagccugcagugccgcaucugcaucuga

SEQ ID NO: 5856 - RNA, 1701 nt, Artificial Sequence
  derived and/or modified CDS sequence (AUadapt) from InfluenzaA__ADM14664__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaacggcgccaucaacaccucccugcccuuccagaacauccaccccaucaccaucgggaagugccccaaguacgucaagucgaccaagcugcggcucgcgaccggccugcgcaacaucccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgagccugguccucguggugucccugggggccaucucguucuggaugugcuccaacggcagccugcagugccggaucugcaucuga

SEQ ID NO: 5857 - RNA, 1701 nt, Artificial Sequence; identical to SEQ ID NO: 116
  derived and/or modified CDS sequence (AUadapt) from InfluenzaA__ADM14673__HA

SEQ ID NO: 5858 - RNA, 1701 nt, Artificial Sequence; identical to SEQ ID NO: 116
  derived and/or modified CDS sequence (AUadapt) from InfluenzaA__ADM14682__HA

SEQ ID NO: 5859 - RNA, 1701 nt, Artificial Sequence; identical to SEQ ID NO: 116
  derived and/or modified CDS sequence (AUadapt) from InfluenzaA__ADM14691__HA

SEQ ID NO: 5860 - RNA, 1701 nt, Artificial Sequence; identical to SEQ ID NO: 4078
  derived and/or modified CDS sequence (AUadapt) from InfluenzaA__ADM14700__HA

SEQ ID NO: 5861 - RNA, 1695 nt, Artificial Sequence
  derived and/or modified CDS sequence (AUadapt) from InfluenzaA__ADM14709__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccagcuccgacaacggcacgugcuaccccggcgacuucaucgacuacgaggagcuccgggagcagcugucguccgugucguccuucgagcgcuucgagaucuuccccaagaccaacagcuggcccaaccacgacuccaacaagggggucaccgccgccugcccgcacgccggcgccaagucguucuacaagaaccugaucuggcucgugaagaaggggaacuccuaccccaagcugagcaaguccuacaucaacgacaagggcaaggaggugcugguccucugggggauccaccaccccucgaccagcgccgaccagcagucccuguaccagaacgccgacgccuacguguucgugggcacgucgaaguacuccaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccgggucgggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcgccucgcgaccggccugcggaacgucccgucgauccagucccgcgggcuguucggcgccaucgccggguucaucgagggcggcuggacggggaugguggacggcugguacggguaccaccaccagaacgagcagggcagcggguacgccgccgaccucaaguccacccagaacgcgaucgacggcaucaccaacaagaucaacucggugaucgagaagaugaacacccaguucacggccgucggcaaggaguucaaccaccuggagaagcggaucgagaaccugaacaagaagguggacgacggguuccucgacaucuggaccuacaacgccgagcugcugguccuccuggagaacgagcgcacccugaacuaccacgacuccaacgugaagaaccucuacgagaaggugcggucgcagcugaagaacaacgccaaggagaucggcaacgggugcuucgaguucuaccacaagugcgacaacacgugcauggaguccgucaagaacggcaccuacgacuaccccaaguacagcgaggaggccaagcugaaccgcgaggagaucgacggggugaagcucgaguccacccggaucuaccagauccuggcgaucuacucgaccguggccuccagccugguccucguggugucgcugggcgccaucuccuucuggaugugcagcggccacuccugccgcaucugcaucuga

SEQ ID NO: 5862 - RNA, 1701 nt, Artificial Sequence
  derived and/or modified CDS sequence (AUadapt) from InfluenzaA__ADM14718__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccaugagcuccuucgagcgcuucgagaucuuccccaagaccucguccuggcccaaccacgacagcaacaagggggugaccgccgccugcccgcacgccggcgcgaaguccuucuacaagaaccugaucuggcucgucaagaaggggaacucguaccccaagcuguccaagagcuacaucaacgacaagggcaaggaggugcuggugcucugggggauccaccaccccucgaccuccgccgaccagcagagccuguaccagaacgccgacgccuacgucuucgugggcacgucccgguacucgaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgagccugguccucguggugucccugggggccaucucguucuggaugugcuccaacggcagccugcagugccggaucugcaucuga

SEQ ID NO: 5863 - RNA, 1695 nt, Artificial Sequence
  derived and/or modified CDS sequence (AUadapt) from InfluenzaA__ADM14728__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaacucguacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgcccacgacugcaacacgaccugccagaccccgaagggcgcgaucaacaccucccugcccuuccagaacauccaccccaucaccaucgggaagugccccaaguacgucaagucgaccaagcugcggcucgccaccggccugcgcaacgugccguccauccagucgcgggggcuguucggcgccaucgccggguucaucgagggcggcuggacggggaugguggacggcugguacggguaccaccaccagaacgagcagggcuccggguacgccgcggaccucaagagcacccagaacgccaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacucgaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggcgaagcugaaccgggaggagaucgacggcgugaagcucgagucgacccgcaucuaccagauccuggccaucuacuccaccguggccucgagccugguccucguggugucccugggggccaucucguucuggaugugcuccggccacagcugccggaucugcaucuga

SEQ ID NO: 5864 - RNA, 1701 nt, Artificial Sequence
  derived and/or modified CDS sequence (AUadapt) from InfluenzaA__ADM14737__HA
augaaggccauccuggugguccuccuguacaccuucgccaccgcgaacgccgacacgcugugcaucggcuaccacgccaacaacucgaccgacaccgugaacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagaagaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggcgaucuacuccaccgucgccucgagccuggugcucguggucucccugggggccaucucguucuggaugugcuccaacggcagccugcagugccgcaucugcaucuga

SEQ ID NO: 5865 - RNA, 1701 nt, Artificial Sequence
  derived and/or modified CDS sequence (AUadapt) from InfluenzaA__ADM14746__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcugggugcuggggaacccggagugcgagucgcuguccaccgcgagcuccuggucguacaucguggagacccccuccagcgacaacggcacgugcuaccccggcgacuucaucgacuacgaggagcuccgggagcagcuguccucggucuccagcuucgagcgcuucgagaucuuccccaagaccuccucguggccgaaccacgacuccaacaagggggugaccgccgccugcccccacgccggcgccaagagcuucuacaagaaccugaucuggcucgugaagaaggggaacuccuaccccaagcugucgaaguccuacaucaacgacaagggcaaggagguccuggugcucugggggauccaccaccccagcaccucggccgaccagcagucccuguaccagaacgccgacgccuacguguucgucggcacgucgcgguacuccaagaaguucaagccggagaucgccauccgccccaaggugcgggaccaggagggccgcaugaacuacuacuggacccugguggagcccggggacaagaucaccuucgaggcgaccggcaaccucgucgugccccgguacgccuucgccauggagcgcaacgccgggagcggcaucaucaucuccgacacgccggugcacgacugcaacacgaccugccagacccccaagggcgccaucaacaccucgcugcccuuccagaacauccaccccaucaccaucgggaagugcccgaaguacgucaaguccaagaagcugcggcucgcgaccggccugcgcaacgugcccagcauccagucccgggggcuguucggcgccaucgccggguucaucgagggcggcuggaccgggaugguggacggcugguacggguaccaccaccagaacgagcagggcucgggguacgccgccgaccucaaguccacgcagaacgcgaucgacgagaucaccaacaaggucaacagcgugaucgagaagaugaacacccaguucaccgccgucggcaaggaguucaaccaccuggagaagcgcaucgagaaccugaacaagaagguggacgacggcuuccucgacaucuggacguacaacgccgagcugcuggugcuccuggagaacgagcggacccuggacuaccacgacuccaacgucaagaaccucuacgagaaggugcgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgucaagcucgaguccacccgcaucuaccagauccuggcgaucuacucgaccguggccuccagccuggugcucgucgugucgcugggggccaucuccuucuggaugugcagcaacggcucccugcagugccggaucugcaucuga

SEQ ID NO: 5866 - RNA, 1695 nt, Artificial Sequence
  derived and/or modified CDS sequence (AUadapt) from InfluenzaA__ADM14756__HA
augaaggccauccuggugguccuccuguacaccuucgccaccgcgaacgccgacacgcugugcgugggcuaccacgccaacaacucgaccgacaccguggacaccguccucgagaagaacgugacggugacccacuccgucaaccugcuggaggacaagcacaacgggaagcucugcaagcugcgcggcguggcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgucagcuccuucgagcgcuucgagaucuuccccaagaccucguccuggcccaaccacgacucgaacaagggggugaccgccgccugcccgcacgccggcgcgaaguccuucuacaagaaccugaucuggcucgugaagaaggggaacagcuaccccaagcuguccaagucguacaucaacgacaagggcaaggagguccuggugcucugggggauccaccaccccagcaccuccgccgaccagcagucgcuguaccagaacgccgacgccuacguguucgucggcacgucccgguacagcaagaaguucaagcccgagaucgccauccgcccgaaggugcgggaccaggagggccgcaugaacuacuacuggacccugguggagcccggggacaagaucaccuucgaggcgaccggcaaccucgucgugccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggucaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgucaagcucgagagcacccgcaucuaccagauccuggcgaucuacuccaccguggccucgagccuggugcucgucgugucccugggggccaucucguucuggaugugcuccggccacagcugccggaucugcaucuga

SEQ ID NO: 5867 - RNA, 1701 nt, Artificial Sequence; identical to SEQ ID NO: 4078
  derived and/or modified CDS sequence (AUadapt) from InfluenzaA__ADM14765__HA

SEQ ID NO: 5868 - RNA, 1695 nt, Artificial Sequence
  derived and/or modified CDS sequence (AUadapt) from InfluenzaA__ADM14775__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcugaacaaguccuacaucaacgacaagggcaaggaggugcugguccucugggggauccaccaccccucgaccagcgccgaccagcagucccuguaccagaacgccgacgccuacguguucgugggcacgucgcgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggucgggcaucaucaucuccgacacgcccgugcacgacugcaacacgaccugccagaccccgaagggcgccaucaacaccagccugcccuuccagaacauccaccccaucaccaucggggagugccccaaguacgugaaguccaccaagcugcggcucgcgaccggccugcgcaacgucccgucgauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacaagaucaccaacaaggugaacucggucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucuggaugugcagcggccacuccugccggaucugcaucuga

SEQ ID NO: 5869 - RNA, 1695 nt, Artificial Sequence
  derived and/or modified CDS sequence (AUadapt) from InfluenzaA__ADM14802__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagauccgcggcgucgcgccccugcaccuggggaagugcaacaucgccggcuggauccucgggaacccggagugcgagucgcuguccaccgccagcuccuggucguacaucguggagaccuccagcuccgacaacggcacgugcuaccccggcgacuucaucgacuacgaggagcugcgggagcagcucucguccgugagcuccuucgagcgcuucgagaucuuccccaagaccucguccuggcccaaccacgacucgaacaagggggucaccgccgccugcccgcacgccggcgcgaaguccuucuacaagaaccugaucuggcuggugaagaaggggaacagcuaccccaagcucuccaagucguacaucaacgacaagggcaaggaggugcugguccugugggggauccaccaccccagcaccuccgccgaccagcagucgcucuaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucgccauggagcgcaacgccggguccggcaucaucaucucggacacgcccgugcacgacugcaacacgaccugccagaccccgaagggcgccaucaacaccucccuccccuuccagaacauccaccccaucaccaucgggaagugccccaaguacgucaagagcaccaagcugcggcuggcgaccggccuccgcaacgugccguccauccagucgcgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcuggagagcacccgcaucuaccagauccucgcgaucuacuccaccgucgccucgagccuggugcugguggucucccucggggccaucucguucuggaugugcuccggccacagcugccggaucugcaucuga

SEQ ID NO: 5870 - RNA, 1704 nt, Artificial Sequence
  derived and/or modified CDS sequence (AUadapt) from InfluenzaA__ADM14830__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagcugcucagcaccgcguccucgugguccuacaucguggagaccagcuccucggacaacggcacgugcuaccccggcgacuucaucgacuacgaggagcugcgggagcagcuguccagcguguccucguucgagcgcuucgagaucuuccccaagaccuccagcuggcccaaccacgacuccaacaagggggucaccgccgccugcccgcacgccggcgccaagucguucuacaagaaccucaucuggcuggugaagaaggggaacuccuaccccaagcugagcaaguccuacaucaacgacaagggcaaggaggugcucguccugugggggauccaccaccccucgaccagcgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccucguggagcccggggacaagaucaccuucgaggcgaccggcaaccugguggucccccgguacgccuucgccauggagcgcaacgccgagucggggaucaucaucuccgacacgcccgugcacgacugcaacacgaccugccagaccccgaagggcgccaucaacaccagccugcccuuccagaacauccaccccaucaccaucggcaagugccccaaguacgugaaguccaccaagcuccggcuggcgaccgggcugcgcaacgucccgucgauccagucccggggccucuucggggccaucgccggcuucaucgagggcggguggacgggcaugguggacgggugguacggcuaccaccaccagaacgagcaggggagcggcuacgccgccgaccugaaguccacccagaacgcgaucgacgagaucaccaacaaggugaacucggucaucgagaagaugaacacccaguucacggccguggggaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacuccaacgugaagaagcuguacgagaagguccgcagccagcugaagaacaacgccaaggagaucggcaacgggugcuucgaguucuaccacaagugcgacaacacgugcauggaguccgugaagaacggcaccuacgacuaccccaaguacucggaggaggccaagcucaaccgggaggagaucgacggggugaagcuggaguccacccgcaucuaccagauccuggcgaucuacagcaccgucgccuccucgcucgugcugguggucagccugggcgccaucuccuucuggaugugcagcgggcacuccugccuccagugccggaucugcaucuga

SEQ ID NO: 5871 - RNA, 1695 nt, Artificial Sequence
  derived and/or modified CDS sequence (AUadapt) from InfluenzaA__ADM14848__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcuccucgcgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccucgcugcccuuccagaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcucgggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccagcucccuggugcucguggucucgcugggggccaucuccuucuggaugugcagcggccacuccugccggaucugcaucuga

SEQ ID NO: 5872 - RNA, 1695 nt, Artificial Sequence
  derived and/or modified CDS sequence (AUadapt) from InfluenzaA__ADM14866__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcgacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaucaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagucgacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccggccacagcugccggaucugcaucuga

SEQ ID NO: 5873 - RNA, 1695 nt, Artificial Sequence
  derived and/or modified CDS sequence (AUadapt) from InfluenzaA__ADM14876__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaaggagaaggaggugcugguccucuggggcauccaccaccccagcaccuccgccgaccagcagucgcuguaccagaacgccgacgccuacguguucguggggacgucccgguacagcaagaaguucaagcccgagaucgccauccgcccgaagguccgggaccaggagggccgcaugaacuacuacuggacccugguggagcccggcgacaagaucaccuucgaggcgaccgggaaccucguggucccccgguacgccuucgccauggagcgcaacgccggcuccgggaucaucaucucggacacgcccgugcacgacugcaacacgaccugccagaccccgaagggcgccaucaacaccucccugcccuuccagaacauccaccccaucaccaucggcaagugccccaaguacgucaagagcaccaagcugcggcucgcgaccgggcugcgcaacgugccguccauccagucgcggggccuguucggggccaucgccggcuucaucgagggcggguggacgggcaugguggacgggugguacggcuaccaccaccagaacgagcagggguccggcuacgccgccgaccucaagucgacccagaacgcgaucgacgagaucaccaacaaggugaacuccgucaucgagaagaugaacacccaguucacggccguggggaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcucgagagcacccgcaucuaccagauccuggcgaucuacuccaccgucgccucgagccuggugcucguggucucccugggcgccaucucguucuggaugugcuccgggcacagcugccggaucugcaucuga

SEQ ID NO: 5874 - RNA, 1704 nt, Artificial Sequence
  derived and/or modified CDS sequence (AUadapt) from InfluenzaA__ADM14885__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagcugcucagcaccgcguccucgugguccuacaucguggagaccagcuccucggacaacggcacgugcuaccccggcgacuucaucgacuacgaggagcugcgggagcagcuguccagcguguccucguucgagcgcuucgagaucuuccccaagaccuccagcuggcccaaccacgacuccaacaagggggucaccgccgccugcccgcacgccggcgccaagucguucuacaagaaccucaucuggcuggugaagaaggggaacuccuaccccaagcugagcaaguccuacaucaacgacaaggagaaggaggugcucguccuguggggcauccaccaccccucgaccagcgccgaccagcagucccuguaccagaacgccgacgccuacguguucguggggacgagccgguacuccaagaaguucaagcccgagaucgucauccgcccgaaggugcgggaccaggagggccgcaugaacuacuacuggacccucguggagcccggcgacaagaucaccuucgaggccaccgggaaccuggucgugccccgguacgcguucgccauggagcgcaacgccgagucgggcaucaucaucuccgacacgcccgugcacgacugcaacacgaccugccagaccccgaagggggccaucaacaccagccugcccuuccagaacauccaccccaucaccaucggcaagugccccaaguacgucaaguccaccaagcuccggcuggccaccggccugcgcaacgugccgucgauccagucccggggccucuucggggcgaucgccggguucaucgagggcggguggacgggcaugguggacggcugguacggguaccaccaccagaacgagcagggcagcggguacgccgccgaccugaaguccacccagaacgccaucgacgagaucaccaacaaggucaacucggugaucgagaagaugaacacccaguucacggcggucggcaaggaguucaaccaccuggagaagcgcaucgagaaccucaacaagaagguggacgacggguuccuggacaucuggaccuacaacgccgagcugcucgugcugcuggagaacgagcggacccucgacuaccacgacuccaacgucaagaagcuguacgagaaggugcgcagccagcugaagaacaacgccaaggagaucggcaacggcugcuucgaguucuaccacaagugcgacaacacgugcauggaguccgugaagaacgggaccuacgacuaccccaaguacucggaggaggccaagcucaaccgggaggagaucgacggcgucaagcuggaguccacccgcaucuaccagauccuggccaucuacagcaccguggcguccucgcucgugcuggucgugagccugggggccaucuccuucuggaugugcagcggccacgggucccuccagugccggaucugcaucuga

SEQ ID NO: 5875 - RNA, 1695 nt, Artificial Sequence
  derived and/or modified CDS sequence (AUadapt) from InfluenzaA__ADM14894__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaaggagaaggaggugcugguccucuggggcauccaccaccccucgaccuccgccgaccagcagagccuguaccagaacgccgacgccuacguguucguggggacgucccgguacucgaagaaguucaagcccgagaucgucauccgcccgaaggugcgggaccaggagggccgcaugaacuacuacuggacccugguggagcccggcgacaagaucaccuucgaggccaccgggaaccucgucgugccccgguacgcguucgccauggagcgcaacgccggcuccgggaucgugaucagcgacacgcccguccacgacugcaacacgaccugccagaccccgaagggcgccaucaacaccucccugcccuuccagaacauccaccccaucaccaucggcaagugccccaaguacgucaagucgaccaagcugcggcucgccaccgggcugcgcaacgugccguccauccagagccggggccuguucggggcgaucgccggcuucaucgagggcggguggacgggcaugguggacgggugguacggcuaccaccaccagaacgagcagggguccggcuacgccgccgaccucaagucgacccagaacgccaucgacgagaucaccaacaaggugaacuccgucaucgagaagaugaacacccaguucacggcgguggggaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaagcucuacgagaaggugcgcucccagcugaagaacaacgccaaggagaucggcaacgggugcuucgaguucuaccacaagugcgacaacacgugcaugaaguccgucaagaacggcaccuacgacuaccccaaguacucggaggaggccaagcugaaccgggaggagaucgacggggugaagcucgagagcacccgcaucuaccagauccuggccaucuacuccaccguggcgucgagccugguccucguggugucccugggcgccaucucguucuggaugugcuccgggcacagcugccggaucugcaucuga

SEQ ID NO: 5876 - RNA, 1695 nt, Artificial Sequence
  derived and/or modified CDS sequence (AUadapt) from InfluenzaA__ADM14903__HA
augaaggccauccuggugguccuccugugcaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccggccacagcugccggaucugcaucuga

SEQ ID NO: 5877 - RNA, 1695 nt, Artificial Sequence
  derived and/or modified CDS sequence (AUadapt) from InfluenzaA__ADM14912__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccggagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccggccacagcugccggaucugcaucuga

SEQ ID NO: 5878 - RNA, 1695 nt, Artificial Sequence
  derived and/or modified CDS sequence (AUadapt) from InfluenzaA__ADM14921__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccggccacagcugccggaucugcaucuga

SEQ ID NO: 5879 - RNA, 1701 nt, Artificial Sequence; identical to SEQ ID NO: 4078
  derived and/or modified CDS sequence (AUadapt) from InfluenzaA__ADM14930__HA

SEQ ID NO: 5880 - RNA, 1701 nt, Artificial Sequence
  derived and/or modified CDS sequence (AUadapt) from InfluenzaA__ADM14948__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaagggguucuacaagaaccugaucuggcucgugaagaagggcaacuccuaccccaagcugucgaaguccuacaucaacgacaaggggaaggaggugcugguccucuggggcauccaccaccccagcaccucggccgaccagcagucccuguaccagaacgccgacgccuacguguucgugggcacgucgcgguacucccgcaaguucaagcccgagaucgccauccggccgaagguccgcgaccaggaggggcggaugaacuacuacuggacccugguggagcccggcgacaagaucaccuucgaggcgaccgggaaccucguggucccccgcuacgccuucgccauggagcggaacgccggcagcggcaucaucaucuccgacacgcccgugcacgacugcaacacgaccugccagaccccggagggggccaucaacaccucgcugcccuuccagaacauccaccccaucaccaucggcaagugccccaaguacgugaaguccaccaagcugcgccucgcgaccgggcugcggaacgucccgagcauccagucccgcggccuguucggggccaucgccggcuucaucgagggcggguggacgggcaugguggacgggugguacggcuaccaccaccagaacgagcaggggucgggcuacgccgccgaccucaaguccacccagaacgcgaucgacgagaucaccaacaaggugaacagcgucaucgagaagaugaacacccaguucacggccgugggcaaggaguucaaccaccuggagaagcggaucgagaaccugaacaagaaggucgacgacggguuccucgacaucuggaccuacaacgccgagcugcuggugcuccuggagaacgagcgcacccuggacuaccacgacuccaacgugaagaaccucuacgagaagguccggucgcagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgcgaggagaucgacggggugaagcucgaguccacccggaucuaccagauccuggcgaucuacucgaccgucgccuccagccuggugcucguggucucgcugggcgccaucuccuucuggaugugcagcaacggcucccugcagugccgcaucugcaucuga

SEQ ID NO: 5881 - RNA, 1695 nt, Artificial Sequence
  derived and/or modified CDS sequence (AUadapt) from InfluenzaA__ADM14966__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccagcuccgacaacggcacgugcuaccccggcgacuucaucgacuacgaggagcugcgggagcagcucucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcuggugaagaaggggaacucguaccccaagcucuccaagagcuacaucaacgacaagggcaaggaggugcugguccugugggggauccaccaccccucgaccuccgccgaccagcagagccucuaccagaacgccgacgccuacguguucgugggcuccucgcgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggagcggcaucaucaucuccgacacccccgugcacgacugcaacacgaccugccagaccccgaagggcgccaucaacaccucgcuccccuuccagaacauccaccccaucacgaucgggaagugccccaaguacgugaaguccaccaagcugcggcuggcgaccggccuccgcaacgucccgagcauccagucccgggggcuguucggcgccaucgccggguucaucgagggcggcuggaccgggaugguggacggcugguacggguaccaccaccagaacgagcagggcucgggguacgccgccgaccugaaguccacgcagaacgcgaucgacgagaucaccaacaaggugaacagcgucaucgagaagaugaacacccaguucaccgccgugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcucgcagcucaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcuggaguccacccgcaucuaccagauccucgcgaucuacucgaccgucgccagcucccuggugcugguggucucgcucggggccaucuccuucuggaugugcagcggccacuccugccggaucugcaucuga

SEQ ID NO: 5882 - RNA, 1701 nt, Artificial Sequence; identical to SEQ ID NO: 96
  derived and/or modified CDS sequence (AUadapt) from InfluenzaA__ADM14975__HA

SEQ ID NO: 5883 - RNA, 1701 nt, Artificial Sequence
  derived and/or modified CDS sequence (AUadapt) from InfluenzaA__ADM14985__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaaggagaaggaggugcugguccucuggggcauccaccaccccagcaccuccgccgaccagcagucgcuguaccagaacgccgacgccuacguguucguggggacgucccgguacagcaagaaguucaagcccgagaucgccauccgcccgaagguccggggccaggagggccgcaugaacuacuacuggacccugguggagcccggggacaagaucaccuucgaggcgaccggcaaccucguggucccccgguacgccuucgccauggagcgcaacgccggguccggcaucgugaucucggacacgcccgugcacgacugcaacacgaccugccagaccccgaagggcgccaucaacaccucccugcccuuccagaacauccacagcaucaccaucgggaagugccccaaguacgucaaguccaccaagcugcggcucgcgaccggccugcgcaacgugcccucgauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggucaacucggugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacuccaacgucaagaaccucuacgagaaggugcgcagccagcugaagaacaacgccaaggagaucgggaacggcugcuucgaguucuaccacaagugcgacaacacgugcauggaguccgugaagaacgggaccuacgacuacccgaaguacucggaggaggccaagcugaaccgggaggagaucgacggcgucaagcucgaguccacccgcaucuaccagauccuggcgaucuacagcaccguggccucgucccuggugcucgucgugagccugggggccaucuccuucuggaugugcagcaacggcucccugcagugccggaucugcaucuga

SEQ ID NO: 5884 - RNA, 1701 nt, Artificial Sequence
  derived and/or modified CDS sequence (AUadapt) from InfluenzaA__ADM23841__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccagucgaccuccgccgaccagcagagccuguaccagaacgccgacgccuacguguucgugggcacgucccgguacucgaagaaguucaagcccgagaucgccauccgccccaagguccgggaccaggagggccgcaugaacuacuacuggacccugguggagccgggggacaagaucaccuucgaggcgaccggcaaccucguggucccccgguacgccuucgccauggagcgcaacgccggguccggcaucaucaucagcgacacgcccgugcacgacugcaacacgaccugccagacccccaagggcgccaucaacaccucccugccguuccagaacauccaccccaucaccaucgggaagugccccaaguacgucaagucgaccaagcugcggcucgcgaccggccugcgcaacgugcccuccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuacccgaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 5885 - RNA, 1701 nt, Artificial Sequence; identical to SEQ ID NO: 4078
  derived and/or modified CDS sequence (AUadapt) from InfluenzaA__ADM23843__HA

SEQ ID NO: 5886 - RNA, 1701 nt, Artificial Sequence
  derived and/or modified CDS sequence (AUadapt) from InfluenzaA__ADM23844__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccaucagcgacaacggcacgugcuaccccggcgacuucaucgacuacgaggagcuccgggagcagcuguccucgguguccagcuucgagcgcuucgagaucuuccccaagaccuccucguggcccaaccacgacuccaacaagggggucaccaccgccugcccgcacgccggcgccaagggguucuacaagaaccugaucuggcucgugaagaagggcaacagcuaccccaagcuguccaagucguacaucaacgacaaggggaaggaggugcugguccucuggggcauccaccaccaguccacgagcgcggaccagcagucgcuguaccagaacgccgacgccuacguguucgugggcaccucccgguacucgaagaaguucaagcccgagaucgccauccgccccaagguccgggaccaggaggggcgcaugaacuacuacuggacccugguggagccgggcgacaagaucaccuucgaggccacggggaaccucguggucccccgguacgcguucgccauggagcgcaacgccggcuccggcaucaucaucagcgacacccccgugcacgacugcaacacgaccugccagacccccaagggggccaucaacaccucccugccguuccagaacauccaccccaucaccaucggcaagugccccaaguacgucaagucgaccaagcugcggcucgccacggggcugcgcaacgugcccuccauccagagccggggccuguucggggcgaucgccggcuucaucgagggcggguggaccggcaugguggacgggugguacggcuaccaccaccagaacgagcagggguccggcuacgccgccgaccucaagucgacccagaacgccaucgacaagaucaccaacaaggugaacuccgucaucgagaagaugaacacgcaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagucggugaagaacggcaccuacgacuacccgaaguacuccgaggaggccaagcugaaccgggaggagaucgacggggugaagcucgagagcacccgcaucuaccagauccuggccaucuacuccaccgucgcgucgucccuggugcucguggucagccugggcgccaucucguucuggaugugcuccaacggcagccugcagugccggaucugcaucuga

SEQ ID NO: 5887 - RNA, 1701 nt, Artificial Sequence
  derived and/or modified CDS sequence (AUadapt) from InfluenzaA__ADM23845__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccaucucggacaacggcacgugcuaccccggcgacuucaucgacuacgaggagcuccgggagcagcuguccagcguguccucguucgagcgcuucgagaucuuccccaagaccuccagcuggcccaaccacgacuccaacaagggggucaccaccgccugcccgcacgccggcgccaagucguucuacaagaaccugaucuggcucgugaagaaggggaacuccuaccccaagcugagcaaguccuacaucaacgacaagggcaaggaggugcugguccucugggggauccaccaccagucgacgagcgcggaccagcagucccuguaccagaacgccgacgccuacguguucgugggcaccucgcgguacuccaagaaguucaagcccgagaucgccauccgccccaagguccgggaccaggagggccgcaugaacuacuacuggacccugguggagccgggggacaagaucaccuucgaggccacgggcaaccucguggucccccgguacgcguucgccauggagcgcaacgccgggagcggcaucaucaucuccgacacccccgugcacgacugcaacacgaccugccagacccccaagggcgccaucaacaccucgcugccguuccagaacauccaccccaucaccaucgggaagugccccaaguacgugaaguccaccaagcugcggcucgccacgggccugcgcaacguccccagcauccagucccgggggcuguucggcgcgaucgccggguucaucgagggcggcuggaccgggaugguggacggcugguacggguaccaccaccagaacgagcagggcucgggguacgccgccgaccucaaguccacccagaacgccaucgacaagaucaccaacaaggugaacagcgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuacccgaaguacagcgaggaggccaagcugaaccgggaggagaucgacggcgugaagcucgaguccacccgcaucuaccagauccuggccaucuacucgaccgucgcguccagccuggugcucguggucucgcugggggccaucuccuucuggaugugcagcaacggcucccugcagugccggaucugcaucuga

SEQ ID NO: 5888 - RNA, 1701 nt, Artificial Sequence
  derived and/or modified CDS sequence (AUadapt) from InfluenzaA__ADM23846__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccaucucggacaacggcacgugcuaccccggcgacuucaucgacuacgaggagcuccgggagcagcuguccagcguguccucguucgagcgcuucgagaucuuccccaagaccuccagcuggcccaaccacgacuccaacaagggggucaccaccgccugcccgcacgccggcgccaagucguucuacaagaaccugaucuggcucgugaagaaggggaacuccuaccccaagcugagcaaguccuacaucaacgacaagggcaaggaggugcugguccucugggggauccaccaccccucgacgagcgcggaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccgggagcggcaucaucaucuccgacacccccgugcacgacugcaacacgaccugccagaccccgaagggcgccaucaacaccucgcugcccuuccagaacauccaccccaucaccaucgggaagugccccaaguacgugaaguccaccaagcugcggcucgccacgggccugcgcaacgucccgagcauccagucccgggggcuguucggcgcgaucgccggguucaucgagggcggcuggaccgggaugguggacggcugguacggguaccaccaccagaacgagcagggcucgggguacgccgccgaccucaaguccacccagaacgccaucgacaagaucaccaacaaggugaacagcgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggccaucuacucgaccgucgcguccagccuggugcucguggucucgcugggggccaucuccuucuggaugugcagcaacggcucccugcagugccggaucugcaucuga

SEQ ID NO: 5889 - RNA, 1701 nt, Artificial Sequence
  derived and/or modified CDS sequence (AUadapt) from InfluenzaA__ADM23847__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccaucucggacaacggcacgugcuaccccggcgacuucaucgacuacgaggagcuccgggagcagcuguccagcguguccucguucgagcgcuucgagaucuuccccaagaccuccagcuggcccaaccacgacuccaacaagggggucaccaccgccugcccgcacgccggcgccaagggguucuacaagaaccugaucuggcucgugaagaagggcaacucguaccccaagcuguccaagagcuacaucaacgacaaggggaaggaggugcugguccucuggggcauccaccaccaguccacgucggcggaccagcagagccuguaccagaacgccgacgccuacguguucgugggcaccucccgguacucgaagaaguucaagcccgagaucgccauccgccccaagguccgggaccaggaggggcgcaugaacuacuacuggacccugguggagccgggcgacaagaucaccuucgaggccacggggaaccucguggucccccgguacgcguucgccauggagcgcaacgugggcuccggcaucaucaucagcgacacccccgugcacgacugcaacacgaccugccagacccccaagggggccaucaacaccucccugccguuccagaacauccaccccaucaccaucggcaagugccccaaguacgucaagucgaccaagcugcggcucgccacggggcugcgcaacgugcccuccauccagagccggggccuguucggggccaucgcgggcuucaucgagggcggguggaccggcaugguggacgggugguacggcuaccaccaccagaacgagcagggguccggcuacgccgccgaccucaagucgacccagaacgccaucgacaagaucaccaacaaggucaacuccgugaucgagaagaugaacacgcaguucaccgccgucggcaaggaguucaaccaccuggagaagcgcaucgagaaccugaacaagaagguggacgacggguuccucgacaucuggaccuacaacgcggagcugcuggugcuccuggagaacgagcggacccuggacuaccacgacagcaacgucaagaaccucuacgagaaggugcgcucccagcugaagaacaacgccaaggagaucggcaacgggugcuucgaguucuaccacaagugcgacaacacgugcauggagucggugaagaacggcaccuacgacuacccgaaguacuccgaggaggccaagcugaaccgggaggagaucgacggggucaagcucgagagcacccgcaucuaccagauccuggccaucuacuccaccguggccucgucccuggugcucgucgugagccugggcgcgaucucguucuggaugugcuccaacggcagccugcagugccggaucugcaucuga

SEQ ID NO: 5890 - RNA, 1701 nt, Artificial Sequence
  derived and/or modified CDS sequence (AUadapt) from InfluenzaA__ADM23849__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccagucgaccuccgccgaccagcagagccuguaccagaacgccgacgccuacguguucgugggcacgucccgguacucgaagaaguucaagcccgagaucgccauccgccccaagguccgggaccaggagggccgcaugaacuacuacuggacccugguggagccgggggacaagaucaccuucgaggcgaccggcaaccucguggucccccgguacgccuucgccauggagcgcaacgccggguccggcaucaucaucagcgacacgcccgugcacgacugcaacacgaccugccagacccccaagggcgccaucaacaccucccugccguuccagaacauccaccccaucaccaucgggaagugccccaaguacgucaagucgaccaagcugcggcucgcgaccggccugcgcaacgugcccuccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuacccgaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 5891 - RNA, 1701 nt, Artificial Sequence
  derived and/or modified CDS sequence (AUadapt) from InfluenzaA__ADM23851__HA
auggaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccagagcaccuccgccgaccagcagucgcuguaccagaacgccgacgccuacguguucgugggcuccagccgguacuccaagaaguucaagcccgagaucgccauccgccccaagguccgggaccaggagggccgcaugaacuacuacuggacgcugguggagccgggggacaagaucaccuucgaggcgaccggcaaccucguggucccccgguacgccuucgccauggagcgcaacgccgggucgggcaucaucaucuccgacacccccgugcacgacugcaacacgaccugccagacccccaagggcgccaucaacaccagccugccguuccacaacauccaccccaucacgaucgggaagugccccaaguacgugaaguccaccaagcugcggcucgcgaccggccugcgcaacguccccucgauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuacccgaaguacucggaggaggccaagcugaaccgggagaagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 5892 - RNA, 1701 nt, Artificial Sequence
  derived and/or modified CDS sequence (AUadapt) from InfluenzaA__ADM23852__HA
auggaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccacaacauccaccccaucacgaucgggaagugccccaaguacgugaaguccaccaagcugcggcucgcgaccggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggagaagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 5893 - RNA, 1701 nt, Artificial Sequence; identical to SEQ ID NO: 5892
  derived and/or modified CDS sequence (AUadapt) from InfluenzaA__ADM23853__HA

SEQ ID NO: 5894 - RNA, 1701 nt, Artificial Sequence; identical to SEQ ID NO: 3156
  derived and/or modified CDS sequence (AUadapt) from InfluenzaA__ADM23855__HA

SEQ ID NO: 5895 - RNA, 1701 nt, Artificial Sequence
  derived and/or modified CDS sequence (AUadapt) from InfluenzaA__ADM23856__HA
augaaggccauccuggugguccuccuguacaccuucgccaccgugaacgcggacacgcugugcaucggcuaccacgccaacaacucgaccgacaccguggacaccguccucgagaagaacgugacggugacccacuccgucaaccugcuggaggacaagcacaacgggaagcucugcaagcugcgcggcguggcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgucucguccuucgagcgcuucgagaucuuccccaagaccagcuccuggcccaaccacgacucgaacaagggggugaccgccgccugcccgcacgccggcgccaaguccuucuacaagaaccugaucuggcucgugaagaaggggaacagcuaccccaagcuguccaagucguacaucaacgacaagcggaaggagguccuggugcucuggggcauccaccaccagagcaccuccgcggaccagcagucgcuguaccagaacgccgacgccuacguguucgucgggacgucccgcuacagcaagaaguucaagcccgagaucgccauccggcccaaggugcgcgaccaggagggccggaugaacuacuacuggacccugguggagccgggcgacaagaucaccuucgaggccaccgggaaccucgucgugccccgcuacgcguucgccauggagcggaacgccggcuccgggaucaucaucucggacacgcccgugcacgacugcaacacgaccugccagacccccaagggcgccaucaacaccucccugccguuccagaacauccaccccaucaccaucggcaagugccccaaguacgucaagagcaccaagcugcgccucgccaccgggcugcggaacgugcccuccauccagucgcgcggccuguucggggcgaucgccggcuucaucgagggcggguggacgggcaugguggacgggugguacggcuaccaccaccagaacgagcagggguccggcuacgccgccgaccucaagagcacccagaacgccaucgacaagaucaccaacaaggucaacuccgugaucgagaagaugaacacccaguucacggcggucgggaaggaguucaaccaccuggagaagcggaucgagaaccugaacaagaagguggacgacggcuuccucgacaucuggaccuacaacgccgagcugcuggugcuccuggagaacgagcgcacccuggacuaccacgacucgaacgucaagaaccucuacgagaaggugcggucccagcugaagaacaacgccaaggagaucggcaacgggugcuucgaguucuaccacaagugcgacaacacgugcauggagagcgugaagaacggcaccuacgacuacccgaaguacuccgaggaggccaagcugaaccgcgaggagaucgacggggucaagcucgagucgacccggaucuaccagauccuggccaucuacuccaccguggcgagcucgcuggugcucgucgugucccugggcgccaucagcuucuggaugugcuccaacgggagccugcagugccgcaucugcaucuga

SEQ ID NO: 5896 - RNA, 1701 nt, Artificial Sequence; identical to SEQ ID NO: 116
  derived and/or modified CDS sequence (AUadapt) from InfluenzaA__ADM25945__HA

SEQ ID NO: 5897 - RNA, 1701 nt, Artificial Sequence; identical to SEQ ID NO: 3156
  derived and/or modified CDS sequence (AUadapt) from InfluenzaA__ADM25948__HA

SEQ ID NO: 5898 - RNA, 1701 nt, Artificial Sequence; identical to SEQ ID NO: 4943
  derived and/or modified CDS sequence (AUadapt) from InfluenzaA__ADM26264__HA

SEQ ID NO: 5899 - RNA, 1701 nt, Artificial Sequence; identical to SEQ ID NO: 4943
  derived and/or modified CDS sequence (AUadapt) from InfluenzaA__ADM26265__HA

SEQ ID NO: 5900 - RNA, 1701 nt, Artificial Sequence; identical to SEQ ID NO: 4943
  derived and/or modified CDS sequence (AUadapt) from InfluenzaA__ADM26266__HA

SEQ ID NO: 5901 - RNA, 1701 nt, Artificial Sequence; identical to SEQ ID NO: 4943
  derived and/or modified CDS sequence (AUadapt) from InfluenzaA__ADM26267__HA

SEQ ID NO: 5902 - RNA, 1701 nt, Artificial Sequence
  derived and/or modified CDS sequence (AUadapt) from InfluenzaA__ADM26268__HA
augaaggccauccuggugguccuccuguacaccuucaccacggccaacgcggacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagacguccucguccgacaacgggaccugcuaccccggcgacuucaucgacuacgaggagcuccgggagcagcugagcuccgugucguccuucgagcgcuucgagaucuuccccaagaccagcuccuggcccaaccacgacucgaacaagggcgucaccgccgccugcccgcacgccggcgccaaguccuucuacaagaaccugaucuggcucgugaagaaggggaacagcuaccccaagcuguccaagucguacaucaacgacaagggcaaggaggugcugguccucugggggauccaccaccccagcacguccgcggaccagcagucgcuguaccagaacgccgacgccuacguguucgugggcaccucccgguacagcaagaaguucaagcccgagaucgccauccgcccgaagguccgggagcaggagggccgcaugaacuacuacuggacccugguggagcccggggacaagaucaccuucgaggccacgggcaaccucguggucccccgguacgcguucgccauggagcgcaacgccggguccggcaucaucaucucggacacccccgugcacgacugcaacacgaccugccagaccccgaagggcgccaucaacaccucccugcccuuccagaacauccacagcaucaccaucgggaagugccccaaguacgugaaguccaccaagcugcggcucgccacgggccugcgcaacguccccucgauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacgagaucaccaacaaggugaacucggucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuacccgaaguacucggaggaggccaagcugaagcgggaggagaucgacggcgugaagcucgaguccacccgcaucuaccagauccuggccaucuacagcaccgucgcgucgucccuggugcucguggucagccugggggccaucuccuucuggaugugcagcaacggcucccugcagugccggaucugcaucuga

SEQ ID NO: 5903 - RNA, 1701 nt, Artificial Sequence
  derived and/or modified CDS sequence (AUadapt) from InfluenzaA__ADM26269__HA
augaagaccauccuggugguccuccuguacaccuucacgaccgccaacgccgacacccugugcaucggcuaccacgcgaacaacucgaccgacacgguggacaccgugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccacggccucguccuggagcuacaucguggagaccuccucguccgacaacgggaccugcuaccccggcgacuucaucgacuacgaggagcuccgggagcagcugagcuccgugucguccuucgagcgcuucgagaucuuccccaagaccagcuccuggcccaaccacgacucgaacaagggcgucacggccgccugcccgcacgccggcgccaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgcggacgccuacguguucgugggcaccucccgguacagcaagaaguucaagcccgagaucgccauccgcccgaagguccgggagcaggagggccgcaugaacuacuacuggacccugguggagcccggggacaagaucacguucgaggccaccggcaaccucguggucccccgguacgccuucgcgauggagcgcaacgccggguccggcaucaucaucucggacacccccgugcacgacugcaacaccacgugccagaccccgaagggcgccaucaacaccucccugcccuuccagaacauccacagcaucaccaucgggaagugccccaaguacgugaaguccacgaagcugcggcucgccaccggccugcgcaacguccccucgauccagucccgggggcuguucggcgccaucgcgggguucaucgagggcggcuggaccgggaugguggacggcugguacggguaccaccaccagaacgagcagggcagcggguacgccgccgaccucaaguccacccagaacgccaucgacgagaucacgaacaaggugaacucggucaucgagaagaugaacacccaguucaccgccgugggcaaggaguucaaccaccuggagaagcgcaucgagaaccugaacaagaaggucgacgacggcuuccucgacaucuggaccuacaacgcggagcugcuggugcuccuggagaacgagcggacgcuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuacccgaaguacucggaggaggccaagcugaagcgggaggagaucgacggcgugaagcucgaguccacccgcaucuaccagauccuggccaucuacagcaccgucgccucgucccuggugcucguggucagccugggggcgaucuccuucuggaugugcagcaacggcucccugcagugccggaucugcaucuga

SEQ ID NO: 5904 - RNA, 1701 nt, Artificial Sequence
  derived and/or modified CDS sequence (AUadapt) from InfluenzaA__ADM26270__HA
augaaggccauccuggugguccuccuguacaccuucaccacggccaacgcggacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagacguccagcuccgacaacgggaccugcuaccccggcgacuucaucgacuacgaggagcuccgggagcagcugucguccgugagcuccuucgagcgcuucgagaucuuccccaagaccucguccuggcccaaccacgacagcaacaagggcgucaccgccgccugcccgcacgccggcgccaaguccuucuacaagaaccugaucuggcucgugaagaaggggaacucguaccccaagcuguccaagagcuacaucaacgacaagggcaaggaggugcugguccucugggggauccaccaccccucgacguccgcggaccagcagagccuguaccagaacgccgacgccuacguguucgugggcaccucccgguacucgaagaaguucaagcccgagaucgccauccgcccgaagguccgggagcaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccacucgaucaccaucgggcggugccccaaguacgugaaguccaccaagcugcgccucgccacgggccugcggaacguccccagcauccagucccgcgggcuguucggcgcgaucgccggguucaucgagggcggcuggaccgggaugguggacggcugguacggguaccaccaccagaacgagcagggcucgggguacgccgccgaccucaaguccacccagaacgccaucgacgagaucaccaacaaggugaacagcgucaucgagaagaugaacacgcaguucaccgcggugggcaaggaguucaaccaccuggagaagcggaucgagaaccugaacaagaaggucgacgacggcuuccucgacaucuggaccuacaacgccgagcugcuggugcuccuggagaacgagcgcacccuggaccaccacgacuccaacgugaagaaccucuacgagaagguccggucgcagcugaagaacaacgccaaggagaucgggaacggcugcuucgaguucuaccacaagugcgacaacacgugcauggaguccgugaagaacgggaccuacgacuacccgaaguacagcgaggaggccaagcugaaccgcgaggagaucgacggcgugaagcucgaguccacccggaucuaccagauccuggccaucuacucgaccgucgcgagcucccuggugcucguggucucgcugggggccaucuccuucuggaugugcagcaacggcucccugcagugccgcaucugcaucuga

SEQ ID NO: 5905 - RNA, 1701 nt, Artificial Sequence; identical to SEQ ID NO: 4943
  derived and/or modified CDS sequence (AUadapt) from InfluenzaA__ADM26271__HA

SEQ ID NO: 5906 - RNA, 1701 nt, Artificial Sequence
  derived and/or modified CDS sequence (AUadapt) from InfluenzaA__ADM26272__HA
augaaggccauccuggugguccuccuguacaccuucaccacggccaacgcggacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagacguccucguccgacaacgggaccugcuaccccggcgacuucaucgacuacgaggagcuccgggagcagcugagcuccgugucguccuucgagcgcuucgagaucuuccccaagaccagcuccuggcccaaccacgacucgaacaagggcgucaccgccgccugcccgcacgccggcgccaaguccuucuacaagaaccugaucuggcucgugaagaaggggaacagcuaccccaagcuguccaagucguacaucaacgacaagggcaaggaggugcugguccucugggggauccaccaccccagcacguccgcggaccagcagucgcuguaccagaacgccgacgccuacguguucgugggcaccucccgguacagcaagaaguucaagcccgagaucgccauccgcccgaagguccgggagcaggagggccgcaugaacuacuacuggacccugguggagcccggggacaagaucaccuucgaggccacgggcaaccucguggucccccgguacgcguucgccauggagcgcaacgccggguccggcaucaucaucucggacacccccgugcacgacugcaacacgaccugccagaccccgaagggcgccaucaacaccucccugcccuuccagaacauccacagcaucaccaucgggcggugccccaaguacgugaaguccaccaagcugcgccucgccacgggccugcggaacguccccucgauccagucccgcgggcuguucggcgcgaucgccggguucaucgagggcggcuggaccgggaugguggacggcugguacggguaccaccaccagaacgagcagggcagcggguacgccgccgaccucaaguccacccagaacgccaucgacgagaucaccaacaaggugaacucggucaucgagaagaugaacacgcaguucaccgcggugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuacccgaaguacucggaggaggccaagcugaaccgcgaggagaucgacggcgugaagcucgaguccacccggaucuaccagauccuggccaucuacagcaccgucgcgucgucccuggugcucguggucagccugggggccaucuccuucuggaugugcagcaacggcucccugcagugccgcaucugcaucuga

SEQ ID NO: 5907 - RNA, 1701 nt, Artificial Sequence
  derived and/or modified CDS sequence (AUadapt) from InfluenzaA__ADM26274__HA
augaaggccauccuggugguccuccuguacaccuucaccacggccaacgcggacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagacguccucguccgacaacgggaccugcuaccccggcgacuucaucgacuacgaggagcuccgggagcagcugagcuccgugucguccuucgagcgcuucgagaucuuccccaagaccagcuccuggcccaaccacgacucgaacaagggcgucaccgccgccugcccgcacgccggcgccaaguccuucuacaagaaccugaucuggcucgugaagaaggggaacagcuaccccaagcuguccaagucguacaucaacgacaagggcaaggaggugcugguccucugggggauccaccaccccagcacguccgcggaccagcagucgcuguaccagaacgccgacgccuacguguucgugggcaccucccgguacagcaagaaguucaagcccgagaucgccauccgcccgaagguccgggagcaggagggccgcaugaacuacuacuggacccugguggagcccggggacaagaucaccuucgaggccacgggcaaccucguggucccccgguacgcguucgccauggagcgcaacgccggguccggcaucaucaucucggacacccccgugcacgacugcaacacgaccugccagaccccgaagggcgccaucaacaccucccugcccuuccagaacauccacagcaucaccaucgggaagugccccaaguacgugaaguccaccaagcugcggcucgccacgggccugcgcaacguccccucgauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacgagaucaccaacaaggugaacucggucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaaggaccucuacgagaagguccgcagccagcugaagaacaacgccaaggagaucgggaacggcugcuucgaguucuaccacaagugcgacaacacgugcauggaguccgugaagaacgggaccuacgacuacccgaaguacucggaggaggccaagcugaaccgggaggagaucgacggcgugaagcucgaguccacccgcaucuaccagauccuggccaucuacagcaccgucgcgucgucccuggugcucguggucagccugggggccaucuccuucuggaugugcagcaacggcucccugcagugccggaucugcaucuga

SEQ ID NO: 5908 - RNA, 1701 nt, Artificial Sequence; identical to SEQ ID NO: 4943
  derived and/or modified CDS sequence (AUadapt) from InfluenzaA__ADM26276__HA

SEQ ID NO: 5909 - RNA, 1701 nt, Artificial Sequence
  derived and/or modified CDS sequence (AUadapt) from InfluenzaA__ADM26277__HA
augaaggccauccuggugguccuccuguacaccuucaccacggccaacgcggacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagacguccucguccgacaacgggaccugcuaccccggcgacuucaucgacuacgaggagcuccgggagcagcugagcuccgugucguccuucgagcgcuucgagaucuuccccaagaccagcuccuggcccaaccacgacucgaacaagggcgucaccgccgccugcccgcacgccggcgccaaguccuucuacaagaaccugaucuggcucgugaagaaggggaacagcuaccccaagcuguccaagucguacaucaacgacaagggcaaggaggugcugguccucugggggauccaccaccccagcacguccgcggaccagcagucgcuguaccagaacgccgacgccuacguguucgugggcaccucccgguacagcaagaaguucaagcccgagaucgccauccgcccgaagguccgggagcaggagggccgcaugaacuacuacuggacccugguggagcccggggacaagaucaccuucgaggccacgggcaaccucguggucccccgguacgcguucgccauggagcgcaacgccggguccggcaucaucaucucggacacccccgugcacgacugcaacacgaccugccagaccccgaagggcgccaucaacaccucccugcccuuccagaacauccacagcaucaccaucgggaagugccccaaguacgugaaguccaccaagcugcggcucgccacgggccugcgcaacguccccucgauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacgagaucaccaacaaggugaacucggucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuacccgaaguacucggaggaggccaagcugaaccgggaggagaucgacggcgugaagcucgaguccacccgcaucuaccagauccuggccaucuacagcaccgucgcgucgucccuggugcucaucgugagccugggggccaucuccuucuggaugugcagcaacggcucccugcagugccggaucugcaucuga

SEQ ID NO: 5910 - RNA, 1701 nt, Artificial Sequence
  derived and/or modified CDS sequence (AUadapt) from InfluenzaA__ADM26278__HA
augaaggccauccuggugguccuccuguacaccuucaccacggccaacgcggacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagacguccucguccgacaacgggaccugcuaccccggcgacuucaucgacuacgaggagcuccgggagcagcugagcuccgugucguccuucgagcgcuucgagaucuuccccaagaccagcuccuggcccaaccacgacucgaacaagggcgucaccgccgccugcccgcacgccggcgccaaguccuucuacaagaaccugaucuggcucgugaagaaggggaacagcuaccccaagcuguccaagucguacaucaacgacaagggcaaggaggugcugguccucugggggauccaccaccccagcacguccgcggaccagcagucgcuguaccagaacgccgacgccuacguguccgugggcaccagccgguacuccaagaaguucaagcccgagaucgccauccgcccgaagguccgggagcaggagggccgcaugaacuacuacuggacccugguggagcccggggacaagaucaccuucgaggccacgggcaaccucguggucccccgguucgcguucgccauggagcgcaacgccgggucgggcaucaucaucuccgacacccccgugcacgacugcaacacgaccugccagaccccgaagggcgccaucaacaccagccugcccuuccagaacauccacuccaucaccaucgggaagugccccaaguacgucaagucgaccaagcugcggcucgccacgggccugcgcaacgugcccuccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuacccgaaguacuccgaggaggccaagcugaagcgggaggagaucgacggcgugaagcucgagagcacccgcaucuaccagauccuggccaucuacucgaccgucgcguccagccuggugcucguggucucccugggggccaucucguucuggaugugcuccaacggcagccugcagugccggaucugcaucuga

SEQ ID NO: 5911 - RNA, 1701 nt, Artificial Sequence
  derived and/or modified CDS sequence (AUadapt) from InfluenzaA__ADM26279__HA
augaaggccauccuggugguccuccuguacaccuucaccacggccaacgcggacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagacguccucguccgacaacgggaccugcuaccccggcgacuucaucgacuacgaggagcuccgggagcagcugagcuccgugucguccuucgagcgcuucgagaucuuccccaagaccagcuccuggcccaaccacgacucgaacaagggcgucaccgccgccugcccgcacgccggcgccaaguccuucuacaagaaccugaucuggcucgugaagaaggggaacagcuaccccaagcuguccaagucguacaucaacgacaagggcaaggaggugcugguccucugggggauccaccaccccagcacguccgcggaccagcagucgcuguaccagaacgccgacgccuacguguucgugggcaccucccgguacagcaagaaguucaagcccgagaucgccauccgcccgaagguccggggccaggaggggcgcaugaacuacuacuggacccugguggagcccggcgacaagaucaccuucgaggccacggggaaccucguggucccccgguacgcguucgccauggagcgcaacgccggcuccggcaucaucaucucggacacccccgugcacgacugcaacacgaccugccagaccccgaagggggccaucaacaccucccugcccuuccagaacauccacagcaucaccaucggcaagugccccaaguacgugaaguccaccaagcugcggcucgccacggggcugcgcaacguccccucgauccagucccggggccuguucggggcgaucgccggcuucaucgagggcggguggaccggcaugguggacgggugguacggcuaccaccaccagaacgagcaggggagcggcuacgccgccgaccucaaguccacccagaacgccaucgacgagaucaccaacaaggugaacucggucaucgagaagaugaacacgcaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacuccaacgugaagaaccucuacgagaagguccgcagccagcugaagaacaacgccaaggagaucggcaacgggugcuucgaguucuaccacaagugcgacaacacgugcauggaguccgugaagaacggcaccuacgacuacccgaaguacucggaggaggccaagcugaaccgggaggagaucgacggggugaagcucgaguccacccgcaucuaccagauccuggccaucuacagcaccgucgcgucgucccuggugcucguggucagccugggcgccaucuccuucuggaugugcagcaacggcucccugcagugccggaucugcaucuga

SEQ ID NO: 5912 - RNA, 1701 nt, Artificial Sequence; identical to SEQ ID NO: 4943
  derived and/or modified CDS sequence (AUadapt) from InfluenzaA__ADM26280__HA

SEQ ID NO: 5913 - RNA, 1701 nt, Artificial Sequence
  derived and/or modified CDS sequence (AUadapt) from InfluenzaA__ADM26281__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagagcauccaccccaucaccaucgggaagugccccaaguacgugaaguccaccaagcugcggcucgcgaccggccugcgcaacgucccgucgauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacaagaucaccaacaaggugaacucggucaucgagaagaugaacacccaguucacggccgugggcaaggaguucaaccaccuggagcgccggaucgagaaccugaacaagaaggucgacgacggcuuccucgacaucuggaccuacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgcgaggagaucgacggcgugaagcucgaguccacccgggucuaccagauccuggcgaucuacagcaccguggccucgucccuggugcucgucgugagccugggggccaucuccuucuggaugugcagcaacggcucccugcagugccgcaucugcaucuga

SEQ ID NO: 5914 - RNA, 1701 nt, Artificial Sequence
  derived and/or modified CDS sequence (AUadapt) from InfluenzaA__ADM26282__HA
augaaggccauccuggugguccuccuguacaccuucaccacggccaacgcggacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagacguccucguccgacaacgggaccugcuaccccggcgacuucaucgacuacgaggagcuccgggagcagcugagcuccgugucguccuucgagcgcuucgagaucuuccccaagaccagcuccuggcccaaccacgacucgaacaagggcgucaccgccgccugcccgcacgccggcgccaaguccuucuacaagaaccugaucuggcucgugaagaaggggaacagcuaccccaagcuguccaagucguacaucaacgacaagggcaaggaggugcugguccucugggggauccaccaccccagcacguccgcggaccagcagucgcuguaccagaacgccgacgccuacguguucgugggcaccucccgguacagcaagaaguucaagcccgagaucgccauccgcccgaagguccgggagcaggagggccgcaugaacuacuacuggacccugguggagcccggggacaagaucaccuucgaggccacgggcaaccucguggucccccgguacgcguucgccauggagcgcaacgccggguccggcaucaucaucucggacacccccgugcacgacugcaacacgaccugccagaccccgaagggcgccaucaacaccucccugcccuuccagaacauccacagcaucaccaucgggaagugccccaaguacgugaaguccaccaagcugcggcucgccacgggccugcgcaacguccccucgauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacgagaucaccaacaaggugaacucggucaucgagaagaugaacacgcaguucaccgcggugggcaaggaguucaaccaccuggagcgccggaucgagaaccugaacaagaaggucgacgacggcuuccucgacaucuggaccuacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuacccgaaguacucggaggaggccaagcugaaccgcgaggagaucgacggcgugaagcucgaguccacccggaucuaccagauccuggccaucuacagcaccgucgcgucgucccuggugcucguggucagccugggggccaucuccuucuggaugugcagcaacggcucccugcagugccgcaucugcaucuga

SEQ ID NO: 5915 - RNA, 1701 nt, Artificial Sequence
  derived and/or modified CDS sequence (AUadapt) from InfluenzaA__ADM26283__HA
augaaggccauccuggugguccuccuguacaccuucaccacggccaacgcggacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagacguccucguccgacaacgggaccugcuaccccggcgacuucaucgacuacgaggagcuccgggagcagcugagcuccgugucguccuucgagcgcuucgagaucuuccccaagaccagcuccuggcccaaccacgacucgaacaagggcgucaccgccgccugcccgcacgccggcgccaaguccuucuacaagaaccugaucuggcucgugaagaaggggaacagcuaccccaagcuguccaagucguacaucaacgacaagggcaaggaggugcugguccucugggggauccaccaccccagcacguccgcggaccagcagucgcuguaccagaacgccgacgccuacguguucgugggcaccucccgguacagcaagaaguucaagcccgagaucgccauccgcccgaagguccgggagcaggagggccgcaugaacuacuacuggacccugguggagcccggggacaagaucaccuucgaggccacgggcaaccucguggucccccgguacgcguucgccauggagcgcaacgccggguccggcaucaucaucucggacacccccgugcacgacugcaacacgaccugccagaccccgaagggcgccaucaacaccucccugcccuuccagaacauccacagcaucaccaucgggaagugccccaaguacgugaaguccaccaagcugcggcucgccacgggccugcgcaacguccccucgauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacgagaucaccaacaaggugaacucggucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuacccgaaguacucggaggaggccaagcugaaccgggagaagaucgacggcgugaagcucgaguccacccgcaucuaccagauccuggccaucuacagcaccgucgcgucgucccuggugcucguggucagccugggggccaucuccuucuggaugugcagcaacggcucccugcagugccggaucugcaucuga

SEQ ID NO: 5916 - RNA, 1701 nt, Artificial Sequence; identical to SEQ ID NO: 4943
  derived and/or modified CDS sequence (AUadapt) from InfluenzaA__ADM26284__HA

SEQ ID NO: 5917 - RNA, 1701 nt, Artificial Sequence; identical to SEQ ID NO: 4943
  derived and/or modified CDS sequence (AUadapt) from InfluenzaA__ADM26285__HA

SEQ ID NO: 5918 - RNA, 1701 nt, Artificial Sequence
  derived and/or modified CDS sequence (AUadapt) from InfluenzaA__ADM26784__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcaugcgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccucggggcggaucaccguguccacgaagcgcagccagcagaccgugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggcggggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 5919 - RNA, 1701 nt, Artificial Sequence; identical to SEQ ID NO: 2679
  derived and/or modified CDS sequence (AUadapt) from InfluenzaA__ADM26795__HA

SEQ ID NO: 5920 - RNA, 1701 nt, Artificial Sequence
  derived and/or modified CDS sequence (AUadapt) from InfluenzaA__ADM26817__HA
augaagaccaccaucgcccugucgcacauccucugccugguguucgcccagaagcugcccggcaacgacaacuccacggcgacccucugccuggggcaccacgccgucccgaacggcaccaucgugaagaccaucacgaacgaccagaucgaggugaccaacgccaccgagcugguccagucguccagcgccggggagaucugcgacucgccccaccagauccucgacggcgagaacugcacccugaucgacgcccugcucggggacccccagugcgacggcuuccagaacaagaagugggaccuguucguggagcgccggcgcgcguacucgaacugcuaccccuacgacgugccggacuacgccucccugcggagccucgucgccuccucgggcacgcuggaguucaacaacgaguccuucaacuggaccggggugacccagaacggcaccucguccgccugcauccgccggagcaacaacuccuucuucucgcgccugaacuggcucacgcaccugaacuucaaguaccccgcgcugaacgugaccaugcccaacaacgagcaguucgacaagcucuacaucuggggcguccaccaccccgggaccgacaaggaccagaucuuccuguacgcccaggccuccgggcggaucaccgugucgacgaagcgcucccagcaggccgugaucccgaacaucggcagccggccccgcguccggaacauccccucgcgcaucuccaucuacuggaccaucgugaagcccggcgacauccugcucaucaacucgaccgggaaccugaucgccccgcggggcuacuucaagauccgcuccgggaaguccuccaucaugcggagcgacgcgcccaucggcaagugcaacuccgagugcaucacccccaacggcucgauccccaacgacaagccguuccagaacgugaaccgcaucacguacggggccugcccccgguacgucaagcaguccacccugaagcucgccaccggcaugcgcaacgugcccgagaagcagacccgggggaucuucggcgccaucgccggguucaucgagaacggcugggagggcaugguggacgggugguacggcuuccgccaccagaacucggaggggcggggccaggcggccgaccugaaguccacgcaggccgccaucgaccagaucaacgggaagcugaaccgccucaucggcaagaccaacgagaaguuccaccagaucgagaaggaguucagcgaggucgagggccgcauccaggaccuggagaaguacguggaggacaccaagaucgaccugugguccuacaacgccgagcuccugguggcgcuggagaaccagcacaccaucgaccucacggacucggagaugaacaagcuguucgagaagaccaagaagcagcugcgggagaacgccgaggacauggggaacggcugcuucaagaucuaccacaagugcgacaacgccugcaucggguccauccgcaacggcaccuacgaccacgacgucuaccgggacgaggcccucaacaaccgcuuccagaucaaggggguggagcucaagucgggcuacaaggacuggauccuguggaucuccuucgccaucagcugcuuccugcugugcguggcgcugcucggcuucaucaugugggccugccagaaggggaacauccggugcaacaucugcaucuga

SEQ ID NO: 5921 - RNA, 1704 nt, Artificial Sequence
  derived and/or modified CDS sequence (AUadapt) from InfluenzaA__ADM31424__HA
auggagaagaucgugcuccuguucaccaccaucucgcuggucaaguccgaccacaucugcaucggcuaccacgccaacaacucgacggagcaggucgacaccaucauggagaagaacgugaccgugacccacgcccaggacauccuggagaagacgcacaacgggaagcucugcgaccugaacggcgugaagccccugauccucaaggacugcuccguggcgggguggcugcugggcaacccgcucugcgacgaguucaucaacguccccgaguggagcuacaucguggagaaggccaaccccgccaacgaccugugcuaccccgggaacuucaacgacuacgaggagcugaagcaccuccugucccgcaucaaccacuucgagaagauccagaucaucccgaaggacucgugguccgaccacgaggccagccugggcguguccgccgcgugcucguaccagggcaacuccagcuucuuccggaacgucguguggcucaucaagaaggacaacgccuaccccaccaucaagaaggacuacaacaacaccaaccaggaggaccugcuggugcucugggggauccaccaccccaacgacgaggccgagcagacccgccuguaccagaaccccacgaccuacaucuccaucggcaccucgacccugaaccagcggcucgucccgaagaucgccacgcgcuccaagaucaacgggcagagcggccggaucgacuucuucuggaccauccugaagcccaacgacgcgauccacuucgaguccaacgggaacuucaucgcccccgaguacgccuacaagaucgugaagaagggcgacucgaccaucaugaaguccgagguggaguacggcaacugcaacacccgcugccagacgcccaucggggccaucaacagcucgaugccguuccacaacauccacccccugaccaucggcgagugccccaaguacgucaaguccaacaagcucgugcuggccaccgggcugcggaacagcccccagcgcgagcggcgccggaagcgcggccucuucggcgcgaucgccggguucaucgagggcggguggcagggcaugguggacgggugguacggcuaccaccacuccaacgagcagggcucgggguacgccgccgacaaggaguccacccagaaggccaucgacggcgucacgaacaaggugaacagcaucaucgacaagaugaacacccaguucgaggcgguggggcgggaguucaacaaccuggagcgccggaucgagaaccugaacaagaagauggaggacggcuuccucgacgucuggaccuacaacgccgagcugcuggugcucauggagaacgagcgcacccuggacuuccacgacuccaacgugaagaaccuguacgacaagguccggcuccagcugaaggacaacgccaaggagcuggggaacggcugcuucgaguucuaccacaagugcaacaacgagugcauggagucggugcgcaacggcacguacgacuacccgcaguacuccgaggaggcccggcucaagcgcgaggagaucagcggggucaagcuggaguccaucggcaucuaccagauccugucgaucuacuccaccguggccagcucccucgugcuggcgaucaugauggccgggcugucgcucuggaugugcuccaacggcagccugcagugccggaucugcaucuga

SEQ ID NO: 5922 - RNA, 1701 nt, Artificial Sequence; identical to SEQ ID NO: 5515
  derived and/or modified CDS sequence (AUadapt) from InfluenzaA__ADM31478__HA

SEQ ID NO: 5923 - RNA, 1701 nt, Artificial Sequence
  derived and/or modified CDS sequence (AUadapt) from InfluenzaA__ADM31488__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccagcuccgacaacggcacgugcuaccccggcgacuucaucgacuacgaggagcugcgggagcagcucucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcuggugaagaaggggaacucguaccccaagcucuccaagagcuacaucaacgacaagggcaaggaggugcugguccugugggggauccaccaccccucgaccuccgccgaccagcagagccucuaccagaacgccgacgccuacguguucgugggcuccucgaaguacuccaagaaguucaagcccgagaucgccauccggccgaagguccgcgaccaggagggccggaugaacuacuacuggacgcugguggagcccggggacaagaucaccuucgaggcgaccggcaaccugguggucccccgcuacgccuucgccauggagcggaacgccgggagcggcaucaucaucuccgacacccccgugcacgacugcaacacgaccugccagaccccgaagggcgccaucaacaccucgcuccccuuccagaacauccaccccaucacgaucgggaagugccccaaguacgugaaguccaccaagcugcgccuggcgaccggccuccggaacgucccgagcauccagucccgcgggcuguucggcgccaucgccggguucaucgagggcggcuggaccgggaugguggacggcugguacggguaccaccaccagaacgagcagggcucgggguacgccgccgaccugaaguccacgcagaacgcgaucgacgagaucaccaacaaggugaacagcgucaucgagaagaugaacacccaguucaccgccgugggcaaggaguucaaccaccucgagaagcggaucgagaaccugaacaagaaggucgacgacggcuuccuggacaucuggacguacaacgccgagcuccuggugcugcucgagaacgagcgcacccuggacuaccacgacuccaacgugaagaaccuguacgagaagguccggucgcagcucaagaacaacgccaaggagguggggaacggcugcuucgaguucuaccacaagugcgacaacacgugcauggaguccgugaagaacgggaccuacgacuaccccaaguacagcgaggaggccaagcugaaccgcgaggagaucgacggcgucaagcuggaguccacccggaucuaccagauccucgcgaucuacucgaccgccgccagcucccuggugcugguggucucgcucggggccaucuccuucuggaugugcagcaacggcucccugcagugccgcaucugcaucuga

SEQ ID NO: 5924 - RNA, 1701 nt, Artificial Sequence
  derived and/or modified CDS sequence (AUadapt) from InfluenzaA__ADM31498__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccuggugaagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagcacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 5925 - RNA, 1701 nt, Artificial Sequence
  derived and/or modified CDS sequence (AUadapt) from InfluenzaA__ADM31508__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagacccggucguggcccaaccacgacuccaacaagggggucaccgccgccugcccgcacgccggcgccaagagcuucuacaagucccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgcuacucgaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagcacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggcgaucuacuccaccgucgccucgagccuggugcucguggucucccugggggccaucucguucuggaugugcuccaacggcagccugcagugccgcaucugcaucuga

SEQ ID NO: 5926 - RNA, 1701 nt, Artificial Sequence
  derived and/or modified CDS sequence (AUadapt) from InfluenzaA__ADM31518__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacgugaacgacaagggcaaggagguccuggugcucugggggauccaccaccccucgaccuccgccgaccagcagagccuguaccagaacgccgacgccuacguguucgucggcacgucccgguacucgaagaaguucaagcccgagaucgccauccgcccgaaggugcgggaccaggagggccgcaugaacuacuacuggacccugguggagcccggggacaagaucaccuucgaggcgaccggcaaccucgucgugccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacaucccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 5927 - RNA, 1701 nt, Artificial Sequence
  derived and/or modified CDS sequence (AUadapt) from InfluenzaA__ADM31528__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagauguuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagguggggaacggcugcuucgaguucuaccacaagugcgacaacacgugcauggagucggugaagaacgggaccuacgacuaccccaaguacuccgaggaggccaagcugaaccgggaggagaucgacggcgucaagcucgagagcacccgcaucuaccagauccuggcgaucuacuccaccguggccucgagccuggugcucgucgugucccugggggccaucucguucuggaugugcuccaacggcagccugcagugccggaucugcaucuga

SEQ ID NO: 5928 - RNA, 1701 nt, Artificial Sequence
  derived and/or modified CDS sequence (AUadapt) from InfluenzaA__ADM31538__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacgacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacaucccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgagccugguccucguggugucccugggggccaucucguucuggaugugcuccaacggcagccugcagugccggaucugcaucuga

SEQ ID NO: 5929 - RNA, 1701 nt, Artificial Sequence
  derived and/or modified CDS sequence (AUadapt) from InfluenzaA__ADM31548__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgaggucgccauccgcccgaaggugcgggaccaggagggccgcaugaacuacuacuggacccugguggagcccggggacaagaucaccuucgaggcgaccggcaaccucgucgugccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacaucccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 5930 - RNA, 1701 nt, Artificial Sequence
  derived and/or modified CDS sequence (AUadapt) from InfluenzaA__ADM31558__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacaucccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagauccggaacgggugcuucgaguucuaccacaagugcgacaacacgugcauggagucggucaagaacggcaccuacgacuaccccaaguacuccgaggaggccaagcugaaccgcgaggagaucgacggggugaagcucgagagcacccggaucuaccagauccuggcgaucuacuccaccguggccucgagccugguccucguggugucccugggcgccaucucguucuggaugugcuccaacgggagccugcagugccgcaucugcaucuga

SEQ ID NO: 5931 - RNA, 1701 nt, Artificial Sequence; identical to SEQ ID NO: 4511
  derived and/or modified CDS sequence (AUadapt) from InfluenzaA__ADM31568__HA

SEQ ID NO: 5932 - RNA, 1701 nt, Artificial Sequence; identical to SEQ ID NO: 116
  derived and/or modified CDS sequence (AUadapt) from InfluenzaA__ADM31578__HA

SEQ ID NO: 5933 - RNA, 1701 nt, Artificial Sequence
  derived and/or modified CDS sequence (AUadapt) from InfluenzaA__ADM31588__HA
augaaggccauccuggugguccuccuguacaccuucgccaccgcgaacgccgacacgcugugcaucggcuaccacgccaacaacucgaccgacaccguggacaccauccucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagucgcuguccaccgccagcuccuggucguacaucgucgagaccuccagcuccgacaacggcacgugcuaccccggcgacuucaucgacuacgaggagcuccgggagcagcugucguccgugagcuccuucgagcgcuucgagauguuccccaagaccucguccuggcccaaccacgacagcaacaagggggugaccgccgccugcccgcacgccggcgcgaaguccuucuacaagaaccugaucuggcucgucaagaaggggaacucguaccccaagcugaacaaguccuacaucaacgacaagggcaaggaggugcuggugcucugggggauccaccaccccagcaccucggccgaccagcagucccuguaccagaacgccgacgccuacgucuucgugggcacgucgcgguacuccaagaaguucaagaccgagaucgccauccgccccaaggugcgggaccaggagggccgcaugaacuacuacuggacccuggucgagccgggggacaagaucaccuucgaggcgacgggcaaccucguggugccccgguacgccuucgccauggagcgcaacgccgggagcggcaucaucaucuccgacacccccguccacgacugcaacacgaccugccagacccccaagggcgccaucaacaccucgcugccguuccagaacauccaccccaucaccaucgggaagugccccaaguacgugaaguccaccaagcugcggcucgcgacgggccugcgcaacgugcccagcauccagucccgggggcuguucggcgccaucgccggguucaucgagggcggcuggaccgggauggucgacggcugguacggguaccaccaccagaacgagcagggcucgggguacgccgccgaccucaaguccacccagaacgcgaucgacgagaucaccaacaaggugaacagcgugaucgagaagaugaacacgcaguucaccgccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcucgcagcugaagaacaacgccaaggaggucgggaacggcugcuucgaguucuaccacaagugcgacaacacgugcauggaguccgugaagaacgggaccuacgacuacccgaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 5934 - RNA, 1701 nt, Artificial Sequence
  derived and/or modified CDS sequence (AUadapt) from InfluenzaA__ADM31598__HA
augaacgccauccuggugguccuccuguacaccuucgccaccgcgaacgccgacacgcugugcaucggcuaccacgccaacaacucgaccgacaccguggacacccuccuggagaagaacgugacggucacccacuccgugaaccugcucgaggacaagcacaacgggaagcugugcaagcugcgcggcguggcgccccuccaccuggggaagugcgacaucgccggcuggauccuggggaacccggagugcgagucgcucuccaccgccagcuccuggucguacaucgucgagaccuccagcuccgacaacggcacgugcuaccccggcgacuucaucgacuacgaggagcugcgggagcagcugucguccgugagcuccuucgagcgcuucgagaucuuccccaagaccucguccuggcccgaccacgacucgaacaagggggugaccgccgccugcccgcacgccggcgcgaaguccuucuacaagaaccucaucuggcuggucaagaaggggaacagcuaccccaagcuguccaagucguacaucaacgacaagggcaaggaggugcucgugcugugggggauccaccaccccagcaccuccgccgaccagcagucgcuguaccagaacgccgacgccuacgucuucgugggcacgucccgguacagcaagaaguucaagcccgagaucgccauccgcccgaaggugcgggaccaggagggccgcaugaacuaccacuggacccucgucgagcccggggacaagaucaccuucgaggcgaccggcaaccugguggugccccgguacgccuucgccauggagcgcaacgccggguccggcaucaucaucucggacgcccccguccacgacugcaacacgaccugccagaccccgaagggcgcgaucaacaccucccugcccuuccagaacauccaccccaucacgaucgggaagugccccaaguacgucaagagcaccaagcuccggcuggccaccggccugcgcaacgugccguccauccagucgcgggggcuguucggcgccaucgccggguucaucgagggcggcuggaccgggaugguggacggcugguacggguaccaccaccagaacgagcagggcuccggguacgccgcggaccucaagucgacgcagaacgccaucgacgagaucaccaacaagaucaacuccgugaucgagaagaugaacacccaguucaccgccgugggcaaggaguucaaccaccuggagaagcgcaucgagaaccucaacaagaaggucgacgacggcuuccuggacaucuggacguacaacgccgagcugcucgugcugcuggagaacgagcggacccucgacuaccacgacagcaacgucaagaaccuguacgagaaggugcgcucccagcugaagaacaacgccaaggagaucgggaacggcugcuucgaguucuaccacaagugcgacaacacgugcauggagucggugaagaacgggaccuacgacuaccccaaguacuccgaggaggcgaagcucaaccgggaggagaucgacggcgucaagcuggagagcacccgcaucuaccagauccuggccaucuacuccaccguggccucgagccucgugcuggucgugucccugggggccaucucguucuggaugugcuccaacggcagccuccagugccggaucugcaucuga

SEQ ID NO: 5935 - RNA, 1701 nt, Artificial Sequence
  derived and/or modified CDS sequence (AUadapt) from InfluenzaA__ADM31608__HA
augaaggccauccuggugguccuccuguacaccuucgccaccgugaacgcggacacgcugugcaucggcuaccacgccaacaacucgaccgacaccguggacaccguccucgagaagaacgugacggugacccacuccgucaaccugcuggaggacaagcacaacgggaagcucugcaagcugcgcggcguggcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgucucguccuucgagcgcuucgagaucuuccccaagaccagcuccuggcccaaccacgacucgaacaagggggugaccgccgccugcccgcacgccggcgccaaguccuucuacaagaaccugaucuggcucgugaagaaggggaacagcuaccccaagcuguccaagucguacaucaacgacaagggcaaggagguccuggugcucugggggauccaccaccccagcaccuccgcggaccagcagucgcuguaccagaacgccgacgccuacguguucgucggcacgucccgguacagcaagaaguucaagcccgagaucgccauccgcccgaaggugcgggaccaggagggccgcaugaacuacuacuggacccugguggagcccggggacaagaucaccuucgaggccaccggcaaccucgucgugccccgguacgcguucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgccaccggccugcgcaacgugccguccauccagucgcgggggcuguucggcgcgaucgccggguucaucgagggcggcuggacggggaugguggacggcugguacggguaccaccaccagaacgagcagggcuccggguacgccgccgaccucaagagcacccagaacgccaucgacaagaucaccaacaaggucaacuccgugaucgagaagaugaacacccaguucacggcggucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacucgaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagucgacccgcaucuaccagauccuggccaucuacuccaccguggcgagcucgcuggugcucgucgugucccugggggccaucagcuucuggaugugcuccaacggcagccugcagugccggaucugcaucuga

SEQ ID NO: 5936 - RNA, 1701 nt, Artificial Sequence; identical to SEQ ID NO: 4466
  derived and/or modified CDS sequence (AUadapt) from InfluenzaA__ADM31618__HA

SEQ ID NO: 5937 - RNA, 1701 nt, Artificial Sequence; identical to SEQ ID NO: 4078
  derived and/or modified CDS sequence (AUadapt) from InfluenzaA__ADM31628__HA

SEQ ID NO: 5938 - RNA, 1701 nt, Artificial Sequence; identical to SEQ ID NO: 5817
  derived and/or modified CDS sequence (AUadapt) from InfluenzaA__ADM31638__HA

SEQ ID NO: 5939 - RNA, 1701 nt, Artificial Sequence; identical to SEQ ID NO: 4334
  derived and/or modified CDS sequence (AUadapt) from InfluenzaA__ADM31648__HA

SEQ ID NO: 5940 - RNA, 1701 nt, Artificial Sequence; identical to SEQ ID NO: 5081
  derived and/or modified CDS sequence (AUadapt) from InfluenzaA__ADM31658__HA

SEQ ID NO: 5941 - RNA, 1701 nt, Artificial Sequence; identical to SEQ ID NO: 4334
  derived and/or modified CDS sequence (AUadapt) from InfluenzaA__ADM31668__HA

SEQ ID NO: 5942 - RNA, 1701 nt, Artificial Sequence; identical to SEQ ID NO: 116
  derived and/or modified CDS sequence (AUadapt) from InfluenzaA__ADM31688__HA

SEQ ID NO: 5943 - RNA, 1701 nt, Artificial Sequence
  derived and/or modified CDS sequence (AUadapt) from InfluenzaA__ADM31698__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacaucccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgagccugauccucgucgugucccugggggccaucucguucuggaugugcuccaacggcagccugcagugccggaucugcaucuga

SEQ ID NO: 5944 - RNA, 1701 nt, Artificial Sequence; identical to SEQ ID NO: 5819
  derived and/or modified CDS sequence (AUadapt) from InfluenzaA__ADM31708__HA

SEQ ID NO: 5945 - RNA, 1701 nt, Artificial Sequence
  derived and/or modified CDS sequence (AUadapt) from InfluenzaA__ADM31718__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacacguacguguucgugggcaccucccgguacucgaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacaagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggccaucuacuccaccgucgcgucgagccuggugcucguggucucccugggggccaucucguucuggaugugcuccaacggcagccugcagugccggaucugcaucuga

SEQ ID NO: 5946 - RNA, 1701 nt, Artificial Sequence
  derived and/or modified CDS sequence (AUadapt) from InfluenzaA__ADM31728__HA
augaaggccauccugaucgugcuccuguacaccuucgccaccgcgaacgccgacacgcugugcaucggcuaccacgccaacaacucgaccgacaccgucgacaccgugcucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagucgcuguccaccgccagcuccuggucguacaucgucgagaccuccagcuccggcaacggcacgugcuaccccggggacuucaucgacuacgaggagcuccgggagcagcugucguccgugagcuccuucgagcgcuucgagaucuuccccaagaccucguccuggcccaaccacgacucgaacaagggcgugaccgccgccugcccgcacgccggggcgaaguccuucuacaagaaccugaucuggcucgucaagaagggcaacagcuaccccaagcuguccaagucguacaucaacgacaaggggaaggaggugcuggugcucuggggcauccaccaccccagcaccuccgccgaccagcagucgcuguaccagaacgccgacgccuacgucuucgugggcacgucccgguacagcaagaaguucaagcccgagaucgccauccgcccgaaggugcgggaccaggaggggcgcaugaacuacuacuggacccuggucgagcccggcgacaagaucaccuucgaggcgaccgggaaccucguggugccccgguacgccuucgccauggagcgcaacgccggcuccggcaucaucacgucggacacccccguccacgacugcaacacgaccugccagaccccgaagggggccaucaacaccucccugcccuuccagaacauccaccccaucaccaucggcaagugccccaaguacgucaagagcaccaagcugcggcucgcgacggggcugcgcaacgugccguccauccagucgcggggccuguucggggccaucgccggcuucaucgagggcggguggaccggcaugguggacgggugguacggcuaccaccaccagaacgagcagggguccggcuacgccgccgaccucaagucgacccagaacgcgaucgacgagaucaccaacaaggugaacuccgugaucgagaagaugaacacgcaguucaccgccgucggcaaggaguucaaccaccuggagaagcgcaucgagaaccugaacaagaagguggacgacggguuccucgacaucuggaccuacaacgccgagcugcugguccuccuggagaacgagcggacccuggacuaccacgacagcaacgugaagaaccucuacgagaaggugcgcucccagcugaagaacaacgccaaggagaucggcaacgggugcuucgaguucuaccacaagugcgacaacacgugcauggagucggucaagaacggcaccuacgacuaccccaaguacuccgaggaggccaagcugaaccgggaggagaucgacggggugaagcucgagagcacccgcaucuaccagauccuggcgaucuacuccaccguggccucgagccugguccucguggugucccugggcgccaucucguucuggaugugcuccaacggcagccugcagugccggaucugcaucuga

SEQ ID NO: 5947 - RNA, 1701 nt, Artificial Sequence
  derived and/or modified CDS sequence (AUadapt) from InfluenzaA__ADM31738__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccagcuccgacaacggcacgugcuaccccggcgacuucaucgacuacgaggagcugcgggagcagcucucguccgugagcuccuucgagcgcuucgagaucuuccccaagaccucguccuggcccaaccacgacagcaacaagggggucaccgccgccugcccgcacgccggcgcgcgguccuucuacaagaaccugaucuggcuggugaagaaggggaacucguaccccaagcucuccaagagcuacaucaacgacaagggcaaggaggugcugguccugugggggauccaccaccccucgaccuccgccgaccagcagagccucuaccagaacgccgacgccuacguguucgugggcacgucccgcuacucgaagaaguucaagcccgagaucgccauccggccgaagguccgcgaccaggagggccggaugaacuacuacuggacccugguggagcccggggacaagaucaccuucgaggcgaccggcaaccugguggucccccgcuacgccuucgccauggagcggaacgccggguccggcaucaucaucagcgacacgcccgugcacgacugcaacacgaccugccagaccccgaagggcgccaucaacaccucccuccccuuccagaacauccaccccaucaccaucgggaagugccccaaguacgucaagucgaccaagcugcgccuggcgaccggccuccggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccuggacaucuggaccuacaacgccgagcuccuggugcugcucgagaacgagcgcacccuggacuaccacgacagcaacgugaagaaccuguacgagaagguccggucccagcucaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcuggagagcacccggaucuaccagauccucgcgaucuacuccaccgucgccucgagccuggugcugguggucucccucggggccaucucguucuggaugugcuccaacggcagccugcagugccgcaucugcaucuga

SEQ ID NO: 5948 - RNA, 1701 nt, Artificial Sequence; identical to SEQ ID NO: 4563
  derived and/or modified CDS sequence (AUadapt) from InfluenzaA__ADM31748__HA

SEQ ID NO: 5949 - RNA, 1701 nt, Artificial Sequence
  derived and/or modified CDS sequence (AUadapt) from InfluenzaA__ADM31758__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcaucgcgccccugcaccucgggaagugcaacaucgccggcuggauccuggggaacccggagugcgagucgcuguccaccgccagcuccuggucguacaucgucgagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggugaccgccgccugcccgcacgccggcgcgaaguccuucuacaagaaccugaucuggcucgucaagaaggggaacucguaccccaagcuguccaagagcuacaucaacgacaagggcaaggaggugcuggugcucugggggauccaccaccccucgaccuccgccgaccagcagagccuguaccagaacgccgacgccuacgucuucgugggcacgucccgguacucgaagaaguucaagcccgagaucgccauccgcccgaaggugcgggaccaggagggccgcaugaacuacuacuggacccugaucgaccccggggacaagaucaccuucgaggcgaccggcaaccucgucgugccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggauggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggucaacuccgugaucgagaagaugaacacccaguucacggccgugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacagcaacgucaagaaccuguacgagaaggugcgcucccagcucaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgucaagcuggagagcacccgcaucuaccagauccucgcgaucuacuccaccguggccucgagccuggugcuggucgugucccucggggccaucucguucuggaugugcuccaacggcagccugcagugccggaucugcaucuga

SEQ ID NO: 5950 - RNA, 1701 nt, Artificial Sequence; identical to SEQ ID NO: 3274
  derived and/or modified CDS sequence (AUadapt) from InfluenzaA__ADM31768__HA

SEQ ID NO: 5951 - RNA, 1701 nt, Artificial Sequence; identical to SEQ ID NO: 116
  derived and/or modified CDS sequence (AUadapt) from InfluenzaA__ADM31778__HA

SEQ ID NO: 5952 - RNA, 1701 nt, Artificial Sequence; identical to SEQ ID NO: 5081
  derived and/or modified CDS sequence (AUadapt) from InfluenzaA__ADM31798__HA

SEQ ID NO: 5953 - RNA, 1701 nt, Artificial Sequence
  derived and/or modified CDS sequence (AUadapt) from InfluenzaA__ADM31808__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccggcaacggcacgugcuaccccggggacuucaucgacuacgaggagcuccgggagcagcugucguccgugagcuccuucgagcgcuucgagaucuuccccaagaccucguccuggcccaaccacgacagcaacaagggcgucaccgccgccugcccgcacgccggggcgaaguccuucuacaagaaccugcucuggcuggugaagaagggcaacucguaccccaagcuguccaagagcuacaucaacgacaaggggaaggaggugcucguccuguggggcauccaccaccccucgaccuccgccgaccagcagagccuguaccagaacgccgacgccuacguguucgugggcacgucccgguacucgaagaaguucaagcccgagaucgccauccgcccgaagguccgggaccaggaggggcgcaugaacuacuacuggacccucgugggccccggggacaagaucaccuucgaggcgaccggcaaccugguggucccccgguacgccuucgccauggagcgcaacgccggcuccgggaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcuccggcuggcgaccggccugcgcaacgugccguccauccagagccgggggcuguucggcgccaucgccggcuucaucgagggcggguggacggggaugguggacggcugguacggguaccaccaccagaacgagcagggcuccggcuacgccgccgaccucaagucgacccagaacgcgaucgacgagaucaccaacaaggugaacuccgucaucgagaagaugaacacccaguucacggccguggggaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacagcaacgugaagaaccuguacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcucaaccgggaggagaucgacggcgugaagcuggagagcacccgcaucuaccagauccuggcgaucuacuccaccgucgccucgagccucgugcugguggucucccugggcgccaucucguucuggaugugcuccaacgggagccuccagugccggaucugcaucuga

SEQ ID NO: 5954 - RNA, 1701 nt, Artificial Sequence; identical to SEQ ID NO: 5081
  derived and/or modified CDS sequence (AUadapt) from InfluenzaA__ADM31818__HA

SEQ ID NO: 5955 - RNA, 1701 nt, Artificial Sequence
  derived and/or modified CDS sequence (AUadapt) from InfluenzaA__ADM31828__HA
augaaggccauccuggugguccuccuguacaccuucgccaccgcgaacgccgacacgcugugcaucggcuaccacgccaacaacucgaccgacaccguggacaccgugcucgagcgcaacgucacggugacccacuccgugaaccugcuggaggacaagcacaacgggaagcucugcaagcugcggggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgcgagcagcugucguccgugagcuccuucgagcgguucgagaucuuccccaagaccucguccuggcccaaccacgacagcaacaagggggucaccgccgccugcccgcacgccggcgcgaaguccuucuacaagaaccugaucuggcucgugaagaagggcaagucguaccccaagcuguccaagagcuacaucaacgacaaggggaaggaggugcugguccucugggggauccaccaccccucgaccuccgccgaccagcagagccuguaccagaacgccgacgccuacguguucgugggcacgucccgcuacucgaagaaguucaagcccgagaucgccauccggccgaagguccgcgagcaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggcgaucuacuccaccgucgccucgagccuggugcuccuggugucccugggggccaucucguucuggaugugcuccaacggcagccuccagugccgcaucugcaucuga

SEQ ID NO: 5956 - RNA, 1701 nt, Artificial Sequence; identical to SEQ ID NO: 5955
  derived and/or modified CDS sequence (AUadapt) from InfluenzaA__ADM31838__HA

SEQ ID NO: 5957 - RNA, 1701 nt, Artificial Sequence; identical to SEQ ID NO: 116
  derived and/or modified CDS sequence (AUadapt) from InfluenzaA__ADM31848__HA

SEQ ID NO: 5958 - RNA, 1701 nt, Artificial Sequence
  derived and/or modified CDS sequence (AUadapt) from InfluenzaA__ADM31858__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcucccacgccggcgccaagucguucuacaagaaccugaucuggcucgugaagaaggggaacuccuacccgaagcugaacaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgccccaagguccgggagcaggagggccgcaugaacuacuacuggacccugguggagccgggggacaagaucaccuucgaggcgaccggcaaccucguggucccccgguacgccuucgccauggagcgcaacgccggguccggcaucaucaucagcgacacgcccgugcacgacugcaacacgaccugccagacccccaagggcgccaucaacaccucccugccguuccagaacauccaccccaucaccaucgggaagugccccaaguacgucaagucgaccaagcugcggcucgcgaccggccugcgcaacgugcccuccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuacccgaaguacuccgaggaggccaagcugaaccgggaggagaucgacggcguggagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 5959 - RNA, 1701 nt, Artificial Sequence
  derived and/or modified CDS sequence (AUadapt) from InfluenzaA__ADM31868__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagcugcucagcaccgcguccucgugguccuacaucguggagaccagcuccucggacaacggcacgugcuaccccggcgacuucaucaacuacgaggagcugcgggagcagcuguccagcguguccucguucgagcgcuucgagaucuuccccaagaccuccagcuggcccaaccacgacuccaacaagggggucaccgccgccugcccgcacgccggcgccaagucguucuacaagaaccucaucuggcuggugaagaaggggaacuccuaccccaagcugagcaaguccuacaucaacgacaagggcaaggaggugcucguccuguggggcgugcaccaccccucgaccagcgccgaccagcagucccuguaccagaacgccgacgccuacguguucgucgggacgucgcgguacuccaagaaguucaagcccgagaucgccauccgcccgaaggugcgggaccaggagggccgcaugaacuacuacuggacccucguggagcccggggacaagaucaccuucgaggcgaccggcaaccuggucgugccccgguacgccuucagcauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcuccggcuggccaccggccugcgcaacgugccguccauccagucgcgggggcuguucggcgcgaucgccggguucaucgagggcggcuggacggggaugguggacggcugguacggguaccaccaccagaacgagcagggcuccggguacgccgccgaccucaagagcacccagaacgccaucgacaagaucaccaacaaggucaacuccgugaucgagaagaugaacacccaguucacggcggucggcaaggaguucaaccaccuggagaagcgcaucgagaaccucaacaagaagguggacgacggcuuccuggacaucuggaccuacaacgccgagcugcucgugcugcuggagaacgagcggacccucgacuaccacgacucgaacgucaagaaccuguacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcucaaccgggagaagaucgacggcgucaagcuggagucgacccgcaucuaccagauccuggccaucuacuccaccguggcgagcucgcucgugcuggucgugucccugggggccaucagcuucuggaugugcuccaacggcagccuccagugccggaucugcaucuga

SEQ ID NO: 5960 - RNA, 1701 nt, Artificial Sequence
  derived and/or modified CDS sequence (AUadapt) from InfluenzaA__ADM31878__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccagcuccgacaacggcacgugcuaccccggcgacuucaucgacuacgaggagcugcgggagcagcucucguccgugagcuccuucgagcgcuucgagaucuuccccaaggccucguccuggcccaaccacgacagcaacaagggggucaccgccgccugcccgcacgcgggcgccaaguccuucuacaagaaccugaucuggcuggugaagaaggggaacucguaccccaagcucuccaagagcuacaucaacgacaagggcaaggaggugcugguccugugggggauccaccaccccucgaccuccgccgaccagcagagccucuaccagaacgccgacgccuacguguucgugggcaccucccgguacucgaagaaguucaagcccgagaucgcgauccgcccgaagguccgggaccaggagggccgcaugaacuacuacuggacgcugguggagcccggggacaagaucaccuucgaggccaccggcaaccugguggucccccgguacgccuucgccauggagcgcaacgccggguccggcaucaucaucagcgacacccccgugcacgacugcaacacgaccugccagaccccgaagggcgcgaucaacaccucccuccccuuccagaacauccaccccaucacgaucgggaagugccccaaguacgucaagucgaccaagcugcggcuggccaccggccuccgcaacgugccguccauccagagccgggggcuguucggcgccaucgccggguucaucgagggcggcuggaccgggaugguggacggcugguacggguaccaccaccagaacgagcagggcuccggguacgccgcggaccucaagucgacgcagaacgccaucgacgagaucaccaacaaggugaacuccgucaucgagaagaugaacacccaguucaccgccgugggcaaggaguucaaccaccuggagaagcgcaucgagaaccugaacaagaaggucgacgacggcuuccuggacaucuggacguacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagucggugaagaacgggaccuacgacuaccccaaguacuccgaggaggcgaagcugaaccgggaggagaucgacggcgugaagcuggagagcacccgcaucuaccagauccucgccaucuacuccaccgucgccucgagccuggugcugguggucucccucggggccaucucguucuggaugugcuccaacggcagccugcagugccggaucugcaucuga

SEQ ID NO: 5961 - RNA, 1701 nt, Artificial Sequence; identical to SEQ ID NO: 4563
  derived and/or modified CDS sequence (AUadapt) from InfluenzaA__ADM31888__HA

SEQ ID NO: 5962 - RNA, 1701 nt, Artificial Sequence; identical to SEQ ID NO: 96
  derived and/or modified CDS sequence (AUadapt) from InfluenzaA__ADM31898__HA

SEQ ID NO: 5963 - RNA, 1701 nt, Artificial Sequence
  derived and/or modified CDS sequence (AUadapt) from InfluenzaA__ADM31908__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccagcuccgacaacggcacgugcuaccccggcgacuucaucgaccacgaggagcugcgggagcagcucucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcuggugaagaaggggaacucguaccccaagcucuccaagagcuacaucaacgacaagggcaaggaggugcugguccugugggggauccaccaccccucgaccuccgccgaccagcagagccucuaccagaacgccgacgccuacguguucgugggcuccucgcgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggagcggcaucaucaucuccgacacccccgugcacgacugcaacacgaccugccagaccccgaagggcgccaucaacaccucgcuccccuuccagaacauccaccccaucacgaucgggaagugccccaaguacgugaaguccaccaagcugcggcuggcgaccggccuccgcaacgucccgagcauccagucccgggggcuguucggcgccaucgccggguucaucgagggcggcuggaccgggaugguggacggcugguacggguaccaccaccagaacgagcagggcucgggguacgccgccgaccugaaguccacgcagaacgcgaucgacgagaucaccaacaaggugaacagcgucaucgagaagaugaacacccaguucaccgccgugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcucgcagcucaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcuggaguccacccgcaucuaccagauccucgcgaucuacucgaccgucgccagcucccuggugcugguggucucgcucggggccaucuccuucuggaugugcagcaacggcucccugcagugccggaucugcaucuga

SEQ ID NO: 5964 - RNA, 1701 nt, Artificial Sequence; identical to SEQ ID NO: 96
  derived and/or modified CDS sequence (AUadapt) from InfluenzaA__ADM31918__HA

SEQ ID NO: 5965 - RNA, 1701 nt, Artificial Sequence; identical to SEQ ID NO: 4686
  derived and/or modified CDS sequence (AUadapt) from InfluenzaA__ADM31928__HA

SEQ ID NO: 5966 - RNA, 1701 nt, Artificial Sequence; identical to SEQ ID NO: 4686
  derived and/or modified CDS sequence (AUadapt) from InfluenzaA__ADM31948__HA

SEQ ID NO: 5967 - RNA, 1701 nt, Artificial Sequence; identical to SEQ ID NO: 116
  derived and/or modified CDS sequence (AUadapt) from InfluenzaA__ADM31958__HA

SEQ ID NO: 5968 - RNA, 1701 nt, Artificial Sequence; identical to SEQ ID NO: 4686
  derived and/or modified CDS sequence (AUadapt) from InfluenzaA__ADM31968__HA

SEQ ID NO: 5969 - RNA, 1701 nt, Artificial Sequence; identical to SEQ ID NO: 4502
  derived and/or modified CDS sequence (AUadapt) from InfluenzaA__ADM31978__HA

SEQ ID NO: 5970 - RNA, 1701 nt, Artificial Sequence; identical to SEQ ID NO: 96
  derived and/or modified CDS sequence (AUadapt) from InfluenzaA__ADM31998__HA

SEQ ID NO: 5971 - RNA, 1701 nt, Artificial Sequence; identical to SEQ ID NO: 96
  derived and/or modified CDS sequence (AUadapt) from InfluenzaA__ADM32008__HA

SEQ ID NO: 5972 - RNA, 1701 nt, Artificial Sequence
  derived and/or modified CDS sequence (AUadapt) from InfluenzaA__ADM32018__HA
augaaggccauccuggugguccuccuguacaccuucgccaucgcgaacgccgacacccugugcaucggcuaccacgccaacaacucgacggacaccguggacaccgugcucgagaagaacgucaccgugacgcacuccgugaaccugcuggaggacaagcacaacgggaagcucugcaagcugcgcggcgucgcgccccugcaccucgggaagugcgacaucgccggcuggauccuggggaacccggagugcgagagccuguccaccgccucguccuggagcuacaucguggagaccuccucguccgacaacgggaccugcuaccccggcgacuucaucgacuacgaggagcuccgggagcagcugagcuccgugucguccuucgagcgcuucgagaucuuccccaagacgagcuccuggcccaaccacgacucgaacaagggcgucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcaccucccgguacagcaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccggguccggcaucaucaucucggacacccccgugcacgacugcaacacgaccugccagaccccgaagggcgccaucaacaccucccugcccuuccagaacauccaccccaucacgaucgggaagugccccaaguacgucaagagcaccaagcugcggcucgcgaccggccugcgcaacgugccguccauccagucgcgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgacccgcaucuaccagauccuggcgaucuacuccaccgucgccagcucgcuggugcucguggucucccugggggccaucagcuucuggaugugcuccaacggcagccugcagugccggaucugcaucuga

SEQ ID NO: 5973 - RNA, 1701 nt, Artificial Sequence
  derived and/or modified CDS sequence (AUadapt) from InfluenzaA__ADM32028__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccguggaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacgugcaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggucaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgucaagcucgagagcacccgcaucuaccagauccuggcgaucuacuccaccguggccucgagccuggugcucgucgugucccugggggccaucucguucuggaugugcuccaacggcagccugcagugccggaucugcaucuga

SEQ ID NO: 5974 - RNA, 1701 nt, Artificial Sequence; identical to SEQ ID NO: 4686
  derived and/or modified CDS sequence (AUadapt) from InfluenzaA__ADM32038__HA

SEQ ID NO: 5975 - RNA, 1701 nt, Artificial Sequence; identical to SEQ ID NO: 96
  derived and/or modified CDS sequence (AUadapt) from InfluenzaA__ADM32048__HA

SEQ ID NO: 5976 - RNA, 1701 nt, Artificial Sequence; identical to SEQ ID NO: 4078
  derived and/or modified CDS sequence (AUadapt) from InfluenzaA__ADM32058__HA

SEQ ID NO: 5977 - RNA, 1701 nt, Artificial Sequence; identical to SEQ ID NO: 4078
  derived and/or modified CDS sequence (AUadapt) from InfluenzaA__ADM32068__HA

SEQ ID NO: 5978 - RNA, 1701 nt, Artificial Sequence; identical to SEQ ID NO: 116
  derived and/or modified CDS sequence (AUadapt) from InfluenzaA__ADM32078__HA

SEQ ID NO: 5979 - RNA, 1701 nt, Artificial Sequence; identical to SEQ ID NO: 4502
  derived and/or modified CDS sequence (AUadapt) from InfluenzaA__ADM32088__HA

SEQ ID NO: 5980 - RNA, 1701 nt, Artificial Sequence
  derived and/or modified CDS sequence (AUadapt) from InfluenzaA__ADM32098__HA
augaaggccauccuggugguccuccuguacaccuucgccaucgcgaacgccgacacccugugcaucggcuaccacgccaacaacucgacggacaccguggacaccgugcucgagaagaacgucaccgugacgcacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacgggaccugcuaccccggcgacuucaucgacuacgaggagcuccgggagcagcugagcuccgugucguccuucgagcgcuucgagaucuuccccaagacgagcuccuggcccaaccacgacucgaacaagggcgucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcaccucccgguacagcaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccggguccggcaucaucaucucggacacccccgugcacgacugcaacacgaccugccagaccccgaagggcgccaucaacaccucccugcccuuccagaacauccaccccaucacgaucgggaagugccccaaguacgucaagagcaccaagcugcggcucgcgaccggccugcgcaacgugccguccauccagucgcgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgacccgcaucuaccagauccuggcgaucuacuccaccgucgccagcucgcuggugcucguggucucccugggggccaucagcuucuggaugugcuccaacggcagccugcagugccggaucugcaucuga

SEQ ID NO: 5981 - RNA, 1701 nt, Artificial Sequence; identical to SEQ ID NO: 116
  derived and/or modified CDS sequence (AUadapt) from InfluenzaA__ADM32108__HA

SEQ ID NO: 5982 - RNA, 1701 nt, Artificial Sequence; identical to SEQ ID NO: 4686
  derived and/or modified CDS sequence (AUadapt) from InfluenzaA__ADM32551__HA

SEQ ID NO: 5983 - RNA, 1701 nt, Artificial Sequence; identical to SEQ ID NO: 96
  derived and/or modified CDS sequence (AUadapt) from InfluenzaA__ADM32561__HA

SEQ ID NO: 5984 - RNA, 1701 nt, Artificial Sequence; identical to SEQ ID NO: 96
  derived and/or modified CDS sequence (AUadapt) from InfluenzaA__ADM32571__HA

SEQ ID NO: 5985 - RNA, 1701 nt, Artificial Sequence; identical to SEQ ID NO: 116
  derived and/or modified CDS sequence (AUadapt) from InfluenzaA__ADM32581__HA

SEQ ID NO: 5986 - RNA, 1701 nt, Artificial Sequence; identical to SEQ ID NO: 4686
  derived and/or modified CDS sequence (AUadapt) from InfluenzaA__ADM32591__HA

SEQ ID NO: 5987 - RNA, 1701 nt, Artificial Sequence; identical to SEQ ID NO: 116
  derived and/or modified CDS sequence (AUadapt) from InfluenzaA__ADM32601__HA

SEQ ID NO: 5988 - RNA, 1701 nt, Artificial Sequence; identical to SEQ ID NO: 116
  derived and/or modified CDS sequence (AUadapt) from InfluenzaA__ADM32611__HA

SEQ ID NO: 5989 - RNA, 1701 nt, Artificial Sequence; identical to SEQ ID NO: 4078
  derived and/or modified CDS sequence (AUadapt) from InfluenzaA__ADM32621__HA

SEQ ID NO: 5990 - RNA, 1701 nt, Artificial Sequence
  derived and/or modified CDS sequence (AUadapt) from InfluenzaA__ADM32631__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcucaagggcgucgcgccccugcaccuggggaagugcaacaucgccggcuggauccucgggaacccggagugcgagagccuguccaccgccucguccuggagcuacaucguggagaccuccucguccgacaacggcacgugcuaccccggcgacuucaucgacuacgaggagcugcgcgagcagcucagcuccgugucguccuucgagcgguucgagaucuuccccaagaccagcuccuggcccaaccacgacucgaacaagggggucaccgccgccugcccgcacgccggcgcgaaguccuucuacaagaaccugaucuggcuggugaagaaggggaaccucuaccccaagcugagcaaguccuacaucaacgacaagggcaaggaggugcugguccucugggggauccaccaccccucgaccagcgccgaccagcagucccuguaccagaacgccgacgccuacguguucgugggcucguccaaguacagcaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccggguccggcaucaucaucucggacacccccgugcacaacugcaacacgaccugccagaccccgaagggcgccaucaacaccucccugcccuuccagaacauccaccccaucacgaucgggaagugccccaaguacgucaagagcaccaagcugcggcucgcgaccggccugcgcaacgugccguccauccagucgcgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgacccgcaucuaccagauccuggcgaucuacuccaccgucgccagcucgcuggugcucguggucucccugggggccaucagcuucuggaugugcuccaacggcagccugcagugccggaucugcaucuga

SEQ ID NO: 5991 - RNA, 1701 nt, Artificial Sequence; identical to SEQ ID NO: 4078
  derived and/or modified CDS sequence (AUadapt) from InfluenzaA__ADM32641__HA

SEQ ID NO: 5992 - RNA, 1701 nt, Artificial Sequence; identical to SEQ ID NO: 116
  derived and/or modified CDS sequence (AUadapt) from InfluenzaA__ADM32651__HA

SEQ ID NO: 5993 - RNA, 1701 nt, Artificial Sequence
  derived and/or modified CDS sequence (AUadapt) from InfluenzaA__ADM32661__HA
augaaggccauccuggugguccuccuguacaccuucgccaucgcgaacgccgacacccugugcaucggcuaccacgccaacaacucgacggacaccguggacaccgugcucgagaagaacgucaccgugacgcacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacgggaccugcuaccccggcgacuucaacgacuacgaggagcuccgggagcagcugucguccgugagcuccuucgagcgcuucgagaucuuccccaagacgucguccuggcccaaccacgacagcaacaagggcgucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcaccucccgguacucgaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucacgaucgggaagugccccaaguacgucaagucgaccaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagucgacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 5994 - RNA, 1701 nt, Artificial Sequence; identical to SEQ ID NO: 4502
  derived and/or modified CDS sequence (AUadapt) from InfluenzaA__ADM32671__HA

SEQ ID NO: 5995 - RNA, 1701 nt, Artificial Sequence; identical to SEQ ID NO: 116
  derived and/or modified CDS sequence (AUadapt) from InfluenzaA__ADM32681__HA

SEQ ID NO: 5996 - RNA, 1701 nt, Artificial Sequence; identical to SEQ ID NO: 96
  derived and/or modified CDS sequence (AUadapt) from InfluenzaA__ADM32691__HA

SEQ ID NO: 5997 - RNA, 1701 nt, Artificial Sequence; identical to SEQ ID NO: 116
  derived and/or modified CDS sequence (AUadapt) from InfluenzaA__ADM32701__HA

SEQ ID NO: 5998 - RNA, 1701 nt, Artificial Sequence; identical to SEQ ID NO: 96
  derived and/or modified CDS sequence (AUadapt) from InfluenzaA__ADM32711__HA

SEQ ID NO: 5999 - RNA, 1701 nt, Artificial Sequence; identical to SEQ ID NO: 96
  derived and/or modified CDS sequence (AUadapt) from InfluenzaA__ADM32721__HA

SEQ ID NO: 6000 - RNA, 1701 nt, Artificial Sequence; identical to SEQ ID NO: 96
  derived and/or modified CDS sequence (AUadapt) from InfluenzaA__ADM32741__HA

SEQ ID NO: 6001 - RNA, 1701 nt, Artificial Sequence; identical to SEQ ID NO: 96
  derived and/or modified CDS sequence (AUadapt) from InfluenzaA__ADM32751__HA

SEQ ID NO: 6002 - RNA, 1701 nt, Artificial Sequence; identical to SEQ ID NO: 4502
  derived and/or modified CDS sequence (AUadapt) from InfluenzaA__ADM32761__HA

SEQ ID NO: 6003 - RNA, 1701 nt, Artificial Sequence
  derived and/or modified CDS sequence (AUadapt) from InfluenzaA__ADM32771__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccgagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagcaaggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggcgaucuacuccaccgucgccucgagccuggugcucguggucucccugggggccaucucguucuggaugugcuccaacggcagccugcagugccgcaucugcaucuga

SEQ ID NO: 6004 - RNA, 1701 nt, Artificial Sequence
  derived and/or modified CDS sequence (AUadapt) from InfluenzaA__ADM32781__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccguggaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccuccuuccccuuccagaacauccaccccaucaccaucgggaagugccccaaguacgucaagagcaccaagcugcggcuggcgaccggccuccgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacucgaacgugaagaaccuguacgagaagguccgcucccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcuggagucgacccgcaucuaccagauccucgcgaucuacuccaccgucgccagcucgcuggugcugguggucucccucggggccaucagcuucuggaugugcuccaacggcagccugcagugccggaucugcaucuga

SEQ ID NO: 6005 - RNA, 1701 nt, Artificial Sequence; identical to SEQ ID NO: 96
  derived and/or modified CDS sequence (AUadapt) from InfluenzaA__ADM32791__HA

SEQ ID NO: 6006 - RNA, 1701 nt, Artificial Sequence
  derived and/or modified CDS sequence (AUadapt) from InfluenzaA__ADM32801__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggagaacaagcacaacgggaagcugugcaagcuccgcggcgucgcgccccugcaccuggggaagugcaacaucgccggcuggauccucgggaacccggagugcgagagccuguccaccgccucguccuggagcuacaucguggagaccuccucguccgacaacggcacgugcuaccccggcgacuucaucgacuacgaggagcugcgggagcagcucagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcuggugaagaaggggaacagcuaccccaagcucuccaagucguacaucaacgacaagggcaaggaggugcugguccugugggggauccaccaccccagcaccuccgccgaccagcagucgcucuaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggucgggcaucaucaucuccgacacccccgugcacgacugcaacacgaccugccagaccccgaagggcgccaucaacaccagccuccccuuccagaacauccaccccaucacgaucgggaagugccccaaguacgugaaguccaccaagcugcggcuggcgaccggccuccgcaacgucccgucgauccagucccgggggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacucggucaucgagaagaugaacacccaguucaccgccgugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcuggaguccacccgcaucuaccagauccucgcgaucuacagcaccgucgccucgucccuggugcugguggucagccucggggccaucuccuucuggaugugcagcaacggcucccugcagugccggaucugcaucuga

SEQ ID NO: 6007 - RNA, 1701 nt, Artificial Sequence
  derived and/or modified CDS sequence (AUadapt) from InfluenzaA__ADM32811__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccacaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 6008 - RNA, 1701 nt, Artificial Sequence; identical to SEQ ID NO: 116
  derived and/or modified CDS sequence (AUadapt) from InfluenzaA__ADM32821__HA

SEQ ID NO: 6009 - RNA, 1701 nt, Artificial Sequence; identical to SEQ ID NO: 4502
  derived and/or modified CDS sequence (AUadapt) from InfluenzaA__ADM32831__HA

SEQ ID NO: 6010 - RNA, 1701 nt, Artificial Sequence; identical to SEQ ID NO: 96
  derived and/or modified CDS sequence (AUadapt) from InfluenzaA__ADM32841__HA

SEQ ID NO: 6011 - RNA, 1701 nt, Artificial Sequence; identical to SEQ ID NO: 4502
  derived and/or modified CDS sequence (AUadapt) from InfluenzaA__ADM32851__HA

SEQ ID NO: 6012 - RNA, 1701 nt, Artificial Sequence; identical to SEQ ID NO: 96
  derived and/or modified CDS sequence (AUadapt) from InfluenzaA__ADM32861__HA

SEQ ID NO: 6013 - RNA, 1701 nt, Artificial Sequence; identical to SEQ ID NO: 4078
  derived and/or modified CDS sequence (AUadapt) from InfluenzaA__ADM32871__HA

SEQ ID NO: 6014 - RNA, 1701 nt, Artificial Sequence; identical to SEQ ID NO: 5081
  derived and/or modified CDS sequence (AUadapt) from InfluenzaA__ADM32881__HA

SEQ ID NO: 6015 - RNA, 1701 nt, Artificial Sequence
  derived and/or modified CDS sequence (AUadapt) from InfluenzaA__ADM32929__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcggugccgcaucugcaucuga

SEQ ID NO: 6016 - RNA, 1701 nt, Artificial Sequence
  derived and/or modified CDS sequence (AUadapt) from InfluenzaA__ADM32939__HA
auggaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccacaacauccaccccaucacgaucgggaagugccccaaguacgugaaguccaccaagcugcggcucgcgaccggccugcgcaacaucccgucgauccagucccgggggcuguucggcgccaucgccggguucaucgagggcggcuggaccgggauggucgacggcugguacggguaccaccaccagaacgagcagggcagcggguacgccgccgaccucaaguccacgcagaacgcgaucgacgagaucaccaacaaggugaacucggugaucgagaagaugaacacccaguucaccgccgucggcaaggaguucaaccaccuggagaagcgcaucgagaaccugaacaagaagguggacgacggcuuccucgacaucuggacguacaacgccgagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuaccccaaguacucggaggaggccaagcugaaccgggaggagaucgacggcgugaagcucgaguccacccgcaucuaccagauccuggcgaucuacagcaccguggccucgucccugguccucguggugagccugggggccaucuccuucuggaugugcagcaacggcucccugcggugccgcaucugcaucuga

SEQ ID NO: 6017 - RNA, 1701 nt, Artificial Sequence
  derived and/or modified CDS sequence (AUadapt) from InfluenzaA__ADM32949__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaacggcgccaucaacaccucccugcccuuccagaacauccaccccaucaccaucgggaagugccccaaguacgucaagucgaccaagcugcggcucgcgaccggccugcgcaacaucccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgagccugguccucguggugucccugggggccaucucguucuggaugugcuccaacggcagccugcggugccgcaucugcaucuga

SEQ ID NO: 6018 - RNA, 1701 nt, Artificial Sequence
  derived and/or modified CDS sequence (AUadapt) from InfluenzaA__ADM32958__HA
augaaggccauccugguguuccuccuguacaccuucgccaccgcgaacgccgacacgcugugcaucggcuaccacgccaacaacucgaccgacaccgucgacaccgugcucgagaagaacgugacggucacccacuccgugaacauccuggaggacaagcacaacgggaagcugugcaagcuccgcggcguggcgccccugcaccuggggaagugcaacaucgccggcuggauccucgggaacccggagugcgagagccuguccaccgccucguccuggagcuacaucgucgagaccuccucguccgacaacggcacgugcuaccccggcgacuucaucgacuacgaggagcugcgggagcagcucagcuccgugucguccuucgagcgcuucgagaucuuccccaagaccagcuccuggcccaaccacgacucgaacaagggggugaccgccgccugcccgcacgccggcgcgaaguccuucuacaagaaccugaucuggcuggucaagaaggggaacagcuaccccaagcucuccaagucguacaucaacgacaagggcaaggaggugcuggugcugugggggauccaccaccccagcaccuccgccgaccagcagucgcucuaccagaacgccgacgccuacgucuucguggaguccagccgguacuccaagaaguucaagcccgagaucgccauccgcccgaaggugcgggaccaggagggccgcaugaacuacuacuggacgcuggucgagcccggcgacaagaucaccuucgaggcgaccgggaaccugguggugccccgguacgccuucgccauggagcgcaacgccggcucggggaucaucaucuccgacacccccguccacgacugcaacacgaccugccagaccccgaagggcgccaucaacaccagccuccccuuccagaacauccaccccaucacgaucggcaagugccccaaguacgugaaguccaccaagcugcggcuggcgaccgggcuccgcaacgugccgucgauccagucccggggccuguucggggccaucgccggcuucaucgagggcggguggaccggcauggucgacgggugguacggcuaccaccaccagaacgagcaggggagcggcuacgccgccgaccugaaguccacgcagaacgcgaucgacgagaucaccaacaaggugaacucggugaucgagaagaugaacacccaguucaccgccgucgggaaggaguucaaccaccucgagaagcgccuggagaaccugaacaagaagguggacgacggcuuccucgacaucuggacguacaacgccgagcugcugguccuccuggagaacgagcggacccuggacuaccacgacuccaacgugaagaaccucuacgagaaggugcgcagccagcugaagaacaacgccaaggaggucggcaacgggugcuucgaguucuaccacaagugcgacaacacgugcauggaguccgugaagaacggcaccuacgacuaccccaaguacucggaggaggccaagcugaaccgggaggagaucgacggggugaagcucgaguccacccgcaucuaccagauccuggcgaucuacagcaccgccgccucgucccugguccucguggugagccugggcgccaucuccuucuggaugugcagcaacgggucccugcggugccgcaucugcaucuga

SEQ ID NO: 6019 - RNA, 1701 nt, Artificial Sequence
  derived and/or modified CDS sequence (AUadapt) from InfluenzaA__ADM32977__HA
augaaggccauccuggugguccuccugugcaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacguccaaguacucgaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacggcaucaccaacaagaucaacuccgugaucgagaagaugaacacccaguucacggccgucggcaaggaguucaaccaccuggagaagcggaucgagaaccugaacaagaagguggacgacggguuccucgacaucuggaccuacaacgccgagcugcugguccuccuggagaacgagcgcacccuggacuaccacgacagcaacgugaagaaccucuacgagaaggugcggucccagcugaagaacaacgccaaggagaucggcaacgggugcuucgaguucuaccacaagugcgacaacacgugcauggagucggucaagaacggcaccuacgacuaccccaaguacuccgaggaggccaagcugaaccgcgaggagaucgacggggugaagcucgagagcacccggaucuaccagauccuggcgaucuacuccaccguggccucgagccugguccucguggugucccugggcgccaucucguucuggaugugcuccaacggcagccugcgcugccggaucugcaucuga

SEQ ID NO: 6020 - RNA, 1701 nt, Artificial Sequence
  derived and/or modified CDS sequence (AUadapt) from InfluenzaA__ADM32986__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccaacucguggcccaaccacgacuccaacaagggggucaccgccgccugcccgcacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacguguucgugggcacgucgaaguacuccaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccgggagcggcaucaucaucuccgacacgcccgugcacgacugcaacacgaccugccagaccccgaagggcgccaucaacaccucgcugcccuuccagaacauccaccccaucaccaucgggaagugccccaaguacgugaaguccaccaagcugcgccucgcgaccggccugcggaacgucccgagcauccagucccgcgggcuguucggcgccaucgccggguucaucgagggcggcuggacggggaugguggacggcugguacggguaccaccaccagaacgagcagggcucgggguacgccgccgaccucaaguccacccagaacgcgaucgacggcaucaccaacaagaucaacagcgugaucgagaagaugaacacccaguucacggccgucggcaaggaguucaaccaccuggagaagcggaucgagaaccugaacaagaagguggacgacggguuccucgacaucuggaccuacaacgccgagcugcugguccuccuggagaacgagcgcacccugaacuaccacgacuccaacgugaagaaccucuacgagaaggugcggucgcagcugaagaacaacgccaaggagaucggcaacgggugcuucgaguucuaccacaagugcgacaacacgugcauggaguccgucaagaacggcaccuacgacuaccccaaguacagcgaggaggccaagcugaaccgcgaggagaucgacggggugaagcucgaguccacccggaucuaccagauccuggcgaucuacucgaccguggccuccagccugguccucguggugucgcugggcgccaucuccuucuggaugugcagcaacggcucccugcgcugccggaucugcaucuga

SEQ ID NO: 6021 - RNA, 1701 nt, Artificial Sequence
  derived and/or modified CDS sequence (AUadapt) from InfluenzaA__ADM32995__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccaacucguggcccaaccacgacuccaacaagggggucaccgccgccugcccgcacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacguguucgugggcacgucgaaguacuccaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccgggagcggcaucaucaucuccgacacgcccgugcacgacugcaacacgaccugccagaccccgaagggcgccaucaacaccucgcugcccuuccagaacauccaccccaucaccaucgggaagugccccaaguacgugaaguccaccaagcugcgccucgcgaccggccugcggaacgucccgagcauccagucccgcgggcuguucggcgccaucgccggguucaucgagggcggcuggacggggaugguggacggcugguacggguaccaccaccagaacgagcagggcucgggguacgccgccgaccucaaguccacccagaacgcgaucgacggcaucaccaacaagaucaacagcgugaucgagaagaugaacacccaguucacggccgucggcaaggaguucaaccaccuggagaagcggaucgagaaccugaacaagaagguggacgacggguuccucgacaucuggaccuacaacgccgagcugcugguccuccuggagaacgagcgcacccuggacuaccacgacuccaacgugaagaaccucuacgagaaggugcggucgcagcugaagaacaacgccaaggagaucggcaacgggugcuucgaguucuaccacaagugcgacaacacgugcauggaguccgucaagaacggcaccuacgacuaccccaaguacagcgaggaggccaagcugaaccgcgaggagaucgacggggugaagcucgaguccacccggaucuaccagauccuggcgaucuacucgaccguggccuccagccugguccucguggugucgcugggcgccaucuccuucuggaugugcagcaacggcucccugcgcugccggaucugcaucuga

SEQ ID NO: 6022 - RNA, 1701 nt, Artificial Sequence; identical to SEQ ID NO: 4015
  derived and/or modified CDS sequence (AUadapt) from InfluenzaA__ADM33004__HA

SEQ ID NO: 6023 - RNA, 1701 nt, Artificial Sequence; identical to SEQ ID NO: 116
  derived and/or modified CDS sequence (AUadapt) from InfluenzaA__ADM33023__HA

SEQ ID NO: 6024 - RNA, 1701 nt, Artificial Sequence
  derived and/or modified CDS sequence (AUadapt) from InfluenzaA__ADM33040__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcggugccgcaucugcaucuga

SEQ ID NO: 6025 - RNA, 1701 nt, Artificial Sequence
  derived and/or modified CDS sequence (AUadapt) from InfluenzaA__ADM33050__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcugaacaaguccuacaucaacgacaagggcaaggaggugcugguccucugggggauccaccaccccagcaccucggccgaccagcagucccuguaccagaacgccgacgccuacguguucgugggcacgucgcgguacuccaagaaguucaagcccgagaucgccauccgcccgaagguccgggaccaggagggccgcaugaacuacuacuggacccugguggagcccggggacaagaucaccuucgaggcgaccggcaaccuccuggugccccgguacgccuucgccauggagcgcaacgccgggagcggcaucaucaucuccgacacgcccguccacgacugcaacacgaccugccagaccccgaagggcgccaucaacaccucgcugcccuuccagaacauccaccccaucaccaucgggaagugccccaaguacgugaaguccaccaagcuccggcuggcgaccggccugcgcaacgugccgagcauccagucccggggccucuucggggccaucgccggguucaucgagggcggcuggacggggauggucgacggcugguacggguaccaccaccagaacgagcagggcucgggguacgccgccgaccugaaguccacccagaacgcgaucgacgagaucaccaacaaggugaacagcgugaucgagaagaugaacacccaguucacggccgucggcaaggaguucaaccaccuggagaagcgcaucgagaaccucaacaagaagguggacgacggcuuccuggacaucuggaccuacaacgccgagcugcucguccugcuggagaacgagcggacccucgacuaccacgacuccaacgugaagaaccuguacgagaaggugcgcucgcagcugaagaacaacgccaaggagaucgggaacggcugcuucgaguucuaccacaagugcgacaacacgugcauggaguccgucaagaacgggaccuacgacuaccccaaguacagcgaggaggccaagcucaaccgggaggagaucgacggcgugaagcuggaguccacccgcaucuaccagauccuggcgaucuacucgaccguggccuccagccucguccugguggugucgcugggggccaucuccuucuggaugugcagcaacggcucccuccggugccgcaucugcaucuga

SEQ ID NO: 6026 - RNA, 1701 nt, Artificial Sequence
  derived and/or modified CDS sequence (AUadapt) from InfluenzaA__ADM33069__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccggagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcggugccgcaucugcaucuga

SEQ ID NO: 6027 - RNA, 1701 nt, Artificial Sequence
  derived and/or modified CDS sequence (AUadapt) from InfluenzaA__ADM33079__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcggugccgcaucugcaucuga

SEQ ID NO: 6028 - RNA, 1701 nt, Artificial Sequence
  derived and/or modified CDS sequence (AUadapt) from InfluenzaA__ADM33099__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucauggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgagccugguccucguggugucccugggggccaucucguucuggaugugcuccaacggcagccugcggugccgcaucugcaucuga

SEQ ID NO: 6029 - RNA, 1701 nt, Artificial Sequence; identical to SEQ ID NO: 6028
  derived and/or modified CDS sequence (AUadapt) from InfluenzaA__ADM33109__HA

SEQ ID NO: 6030 - RNA, 1701 nt, Artificial Sequence
  derived and/or modified CDS sequence (AUadapt) from InfluenzaA__ADM33128__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcggugccgcaucugcaucuga

SEQ ID NO: 6031 - RNA, 1701 nt, Artificial Sequence; identical to SEQ ID NO: 6030
  derived and/or modified CDS sequence (AUadapt) from InfluenzaA__ADM33137__HA

SEQ ID NO: 6032 - RNA, 1701 nt, Artificial Sequence; identical to SEQ ID NO: 6030
  derived and/or modified CDS sequence (AUadapt) from InfluenzaA__ADM33147__HA

SEQ ID NO: 6033 - RNA, 1701 nt, Artificial Sequence; identical to SEQ ID NO: 6030
  derived and/or modified CDS sequence (AUadapt) from InfluenzaA__ADM33157__HA

SEQ ID NO: 6034 - RNA, 1701 nt, Artificial Sequence
  derived and/or modified CDS sequence (AUadapt) from InfluenzaA__ADM33167__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccagcuccgacaacggcacgugcuaccccggcgacuucaucgacuacgaggagcugcgggagcagcucucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcuggugaagaaggggaacucguaccccaagcucuccaagagcuacaucaacgacaagggcaaggaggugcugguccugugggggauccaccaccccucgaccuccgccgaccagcagagccucuaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucgccauggagcgcaacgccggguccggcaucaucaucagcgacacgcccgugcacgacugcaacacgaccugccagaccccgaagggcgccaucaacaccucccuccccuuccagaacauccaccccaucaccaucgggaagugccccaaguacgucaagucgaccaagcugcggcuggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagucggugaagaacgggaccuacgacuaccccaaguacuccgaggaggccaagcugaaccgggagaagaucgacggcgugaagcuggagagcacccgcaucuaccagauccucgcgaucuacuccaccgucgccucgagccuggugcugguggucucccucggggccaucucguucuggaugugcuccaacggcagccugcggugccgcaucugcaucuga

SEQ ID NO: 6035 - RNA, 1701 nt, Artificial Sequence; identical to SEQ ID NO: 5101
  derived and/or modified CDS sequence (AUadapt) from InfluenzaA__ADM33177__HA

SEQ ID NO: 6036 - RNA, 1701 nt, Artificial Sequence; identical to SEQ ID NO: 6030
  derived and/or modified CDS sequence (AUadapt) from InfluenzaA__ADM33186__HA

SEQ ID NO: 6037 - RNA, 1701 nt, Artificial Sequence; identical to SEQ ID NO: 6030
  derived and/or modified CDS sequence (AUadapt) from InfluenzaA__ADM33195__HA

SEQ ID NO: 6038 - RNA, 1701 nt, Artificial Sequence; identical to SEQ ID NO: 6027
  derived and/or modified CDS sequence (AUadapt) from InfluenzaA__ADM33204__HA

SEQ ID NO: 6039 - RNA, 1701 nt, Artificial Sequence
  derived and/or modified CDS sequence (AUadapt) from InfluenzaA__ADM33222__HA
auggaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcuccucgcgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccucgcugcccuuccacaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcucgggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcggugccgcaucugcaucuga

SEQ ID NO: 6040 - RNA, 1701 nt, Artificial Sequence
  derived and/or modified CDS sequence (AUadapt) from InfluenzaA__ADM33232__HA
auggaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccacaacauccaccccaucacgaucgggaagugccccaaguacgugaaguccaccaagcugcggcucgcgaccggccugcgcaacgucccgucgauccagucccgggggcuguucggcgccaucgccggguucaucgagggcggcuggaccgggaugguggacggcugguacggguaccaccaccagaacgagcagggcucgggguacgccgccgaccucaaguccacgcagaacgcgaucgacgagaucaccaacaaggugaacagcgucaucgagaagaccaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 6041 - RNA, 1701 nt, Artificial Sequence
  derived and/or modified CDS sequence (AUadapt) from InfluenzaA__ADM33241__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccucguccuggagcuacaucguggagaccuccucguccgacaacggcacgugcuaccccggcgacuucaucgacuacgaggagcugcgggagcagcucagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcuggugaagaaggagaacagcuaccccaagcucuccaagucguacaucaacgacaaggggaaggaggugcugguccuguggggcauccaccaccccagcaccuccgccgaccagcagucgcucuaccagaacgccgacgccuacguguucgugggguccagccgguacuccaagaaguucaagcccgagaucacgauccgcccgaagguccgggaccaggagggccgcaugaacuacuacuggacccugguggagcccggcgacaagaucaccuucgaggccaccgggaaccugguggucccccgguacgcguucgccauggagcgcaacgccggcucggggaucaucaucuccgacacgcccgugcacgacugcaacacgaccugccagaccccgaagggcgccaucaacaccagccuccccuuccagaacauccaccccaucaccaucggcaagugccccaaguacgugaaguccaccaagcugcggcuggccaccgggcuccgcaacgucccgucgauccagucccggggccuguucggggcgaucgccggcuucaucgagggcggguggacgggcaugguggacgggugguacggcuaccaccaccagaacgagcaggggagcggcuacgccgccgaccugaaguccacccagaacgccaucgacgagaucaccaacaaggugaacucggucaucgagaagaugaacacccaguucacggcgguggggaaggaguucaaccaccucgagaagcgcaucgagaaccugaacaagaaggucgacgacggcuuccuggacaucuggaccuacaacgccgagcuccuggugcugcucgagaacgagcggacccuggacuaccacgacuccaacgugaagaaccuguacgagaagguccgcagccagcucaagaacaacgccaaggagaucggcaacgggugcuucgaguucuaccacaagugcgacaacacgugcauggaguccgugaagaacggcaccuacgacuaccccaaguacucggaggaggccaagcugaaccgggaggagaucgacggggugaagcuggaguccacccgcaucuaccagauccucgccaucuacagcaccgucgcgucgucccuggugcugguggucagccucggcgccaucuccuucuggaugugcagcaacgggucccugcggugccgcaucugcaucuga

SEQ ID NO: 6042 - RNA, 1701 nt, Artificial Sequence; identical to SEQ ID NO: 6039
  derived and/or modified CDS sequence (AUadapt) from InfluenzaA__ADM33251__HA

SEQ ID NO: 6043 - RNA, 1701 nt, Artificial Sequence
  derived and/or modified CDS sequence (AUadapt) from InfluenzaA__ADM33260__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccucguccuggagcuacaucguggagaccuccucguccgacaacggcacgugcuaccccggcgacuucaucgacuacgaggagcugcgggagcagcucagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcuggugaagaagggggacagcuaccccaagcucuccaagucguacaucaacgacaagggcaaggaggugcugguccugugggggauccaccaccccagcaccuccgccgaccagcagucgcucuaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggucgggcaucaucaucuccgacacccccgugcacgacugcaacacgaccugccagaccccgaagggcgccaucaacaccagccuccccuuccagaacauccaccccaucacgaucgggaagugccccaaguacgugaaguccaccaagcugcggcuggcgaccggccuccgcaacgucccgucgauccagucccgggggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacucggucaucgagaagaugaacacccaguucaccgccgugggcaaggaguucaaccaccucgagaagcgcaucgagaaccugaacaagaaggucgacgacggcuuccuggacaucuggacguacaacaccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcuggaguccacccgcaucuaccagauccucgccaucuacagcaccgucgcgucgucccuggugcugguggucagccucggggccaucuccuucuggaugugcagcaacggcucccugcggugccgcaucugcaucuga

SEQ ID NO: 6044 - RNA, 1701 nt, Artificial Sequence
  derived and/or modified CDS sequence (AUadapt) from InfluenzaA__ADM33280__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgugucguccuggagcuacaucguggagaccuccucguccgacaacggcacgugcuaccccggcgacuucaucgacuacgaggagcugcgggagcagcucagcuccgucucguccuucgagcgcuucgagaucuuccccaagaccagcuccuggcccaaccacgacagcaacaagggggugaccgccgccugcccgcacgccggcgccaaguccuucuacaagaaccugaucuggcuggugaagaaggggaacucguaccccaagcucuccaagagcuacaucaacgacaagggcaaggagguccuggugcugugggggauccaccaccccucgaccuccgcggaccagcagagccucuaccagaacgccgacgccuacguguucgucggcuccucgcgguacuccaagaaguucaagcccgagaucgccauccgcccgaaggugcgggaccaggagggccgcaugaacuacuacuggacgcugguggagcccggggacaagaucaccuucgaggccaccggcaaccuggucgugccccgguacgcguucgccauggagcgcaacgccgggagcggcaucaucaucuccgacacccccgugcacgacugcaacacgaccugccagaccccgcggggcgccaucaacaccucgcuccccuuccagaacauccaccccaucacgaucgggaagugccccaaguacgucaaguccaccaagcugcgccuggccaccggccuccggaacgugccgagcauccagucccgcgggcuguucggcgcgaucgccggguucaucgagggcggcuggaccgggaugguggacggcugguacggguaccaccaccagaacgagcagggcagcggguacgccgccgaccugaaguccacgcagaacgccaucgacgagaucaccaacaaggucaacucggugaucgagaagaugaacacccaguucaccgcggucggcaaggaguucaaccaccucgagaagcggaucgagaaccugaacaagaagguggacgacggcuuccuggacaucuggacguacaacgccgagcuccuggugcugcucgagaacgagcgcacccuggacuaccacgacuccaacgucaagaaccuguacgagaaggugcggagccagcucaagaacaacgccaaggagaucgggaacggcugcuucgaguucuaccacaagugcgacaacacgugcauggaguccgugaagaacgggaccuacgacuaccccaaguacucggaggaggccaagcugaaccgcgaggagaucgacggcgucaagcuggaguccacccggaucuaccagauccucgccaucuacagcaccguggcgucgucccuggugcuggucgugagccucggggccaucuccuucuggaugugcagcaacggcucccugcagugccgcaucugcaucuga

SEQ ID NO: 6045 - RNA, 1701 nt, Artificial Sequence; identical to SEQ ID NO: 3361
  derived and/or modified CDS sequence (AUadapt) from InfluenzaA__ADM33290__HA

SEQ ID NO: 6046 - RNA, 1701 nt, Artificial Sequence; identical to SEQ ID NO: 116
  derived and/or modified CDS sequence (AUadapt) from InfluenzaA__ADM33300__HA

SEQ ID NO: 6047 - RNA, 1701 nt, Artificial Sequence; identical to SEQ ID NO: 62
  derived and/or modified CDS sequence (AUadapt) from InfluenzaA__ADM33310__HA

SEQ ID NO: 6048 - RNA, 1701 nt, Artificial Sequence
  derived and/or modified CDS sequence (AUadapt) from InfluenzaA__ADM33320__HA
augaaggccauccugguggucaugcucuacaccuucgccaccgcgaacgccgacacgcugugcaucggcuaccacgccaacaacucgaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagagccuguccaccgcgucguccuggagcuacaucguggagaccuucuccucggacaacggcacgugcuaccccggcgacuucaucgacuacgaggagcugcgggagcagcucuccagcguguccucguucgagcgcuucgagaucuuccccaagaccuccagcuggcccaaccacgacuccaacaagggggucaccgccgccugcccgcacgccggcgccaagagcuucuacaagaaccugaucuggcuggugaagaaggggaacuccuaccccaagcucucgaaguccuacaucaacgacaagggcaaggaggugcugguccugugggggauccaccaccccagcaccucggccgaccagcagucccucuaccagaacgccgacgccuacguguucgugggcagcucccgguacucgaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccggguccggcaucaucaucagcgacacccccgugcacgacugcaacacgaccugccagaccccgaagggcgccaucaacaccucccuccccuuccagaacauccaccccaucacgaucgggaagugccccaaguacgucaagucgaccaagcugcggcuggcgaccggccuccgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccuggacaucuggacguacaacgccgagcuccuggugcugcucgagaacgagcggacccuggacuaccacgacucgaacgugaagaaccuguacgagaagguccgcucccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcuggagucgacccgcaucuaccagauccucgcgaucuacuccaccgucgccagcucgcuggugcugguggucucccucggggccaucagcuucuggaugugcuccaacggcagccugcagugccggaucugcaucuga

SEQ ID NO: 6049 - RNA, 1701 nt, Artificial Sequence; identical to SEQ ID NO: 2940
  derived and/or modified CDS sequence (AUadapt) from InfluenzaA__ADM33340__HA

SEQ ID NO: 6050 - RNA, 1701 nt, Artificial Sequence
  derived and/or modified CDS sequence (AUadapt) from InfluenzaA__ADM33355__HA
augaaggccauccugguggucaugcucuacaccuucgccaccgcgaacgccgacacgcugugcaucggcuaccacgccaacaacucgaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagagccuguccaccgccucguccuggagcuacaucguggagaccuccucguccgacaacggcacgugcuaccccggcgacuucaucgacuacgaggagcugcgggagcagcucagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcuggugaagaaggggaacagcuaccccaagcucuccaagucguacaucaacgacaagggcaaggaggugcugguccugugggggauccaccaccccagcaccuccgccgaccagcagucgcucuaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggucgggcaucaucaucuccgacacccccgugcacaacugcaacacgaccugccagaccccgaagggcgccaucaacaccagccuccccuuccagaacauccaccccaucacgaucgggaagugccccaaguacgugaaguccaccaagcugcggcuggcgaccggccuccgcaacgucccgucgauccagucccgggggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacucggucaucgagaagaugaacacccaguucaccgccgugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcuggaguccacccgcaucuaccagauccucgcgaucuacagcaccgucgccucgucccuggugcugguggucagccucggggccaucuccuucuggaugugcagcaacggcucccugcagugccggaucugcaucuga

SEQ ID NO: 6051 - RNA, 1701 nt, Artificial Sequence; identical to SEQ ID NO: 6050
  derived and/or modified CDS sequence (AUadapt) from InfluenzaA__ADM33365__HA

SEQ ID NO: 6052 - RNA, 1701 nt, Artificial Sequence; identical to SEQ ID NO: 2940
  derived and/or modified CDS sequence (AUadapt) from InfluenzaA__ADM33375__HA

SEQ ID NO: 6053 - RNA, 1701 nt, Artificial Sequence
  derived and/or modified CDS sequence (AUadapt) from InfluenzaA__ADM33385__HA
augaaggccauccugguggucaugcucuacaccuucgccaccgcgaacgccgacacgcugugcaucggcuaccacgccaacaacucgaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagagccuguccaccgccucguccuggagcuacaucguggagaccuccucguccgacaacggcacgugcuaccccggcgacuucaucgacuacgaggagcugcgggagcagcucagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcuggugaagaaggggaacagcuaccccaagcucuccaagucguacaucaacgacaagggcaaggaggugcugguccugugggggauccaccaccccagcaccuccgccgaccagcagagccucuaccagaacgccgacgccuacguguucgugggcuccucgcgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggagcggcaucaucaucuccgacacccccgugcacgacugcaacacgaccugccagaccucgaagggcgccaucaacaccucccucccguuccagaacauccaccccaucacgaucgggaagugccccaaguacgucaagagcaccaagcugcggcuggcgaccggccuccgcaacgugcccuccauccagucgcgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccuggacaucuggacguacaacgccgagcuccuggugcugcucgagaacgagcggacccuggacuaccacgacucgaacgugaagaaccuguacgagaagguccgcucccagcucaagaacaacgccaaggagaucgggaacggcugcuucgaguucuaccacaagugcgacaacacgugcauggagagcgugaagaacgggaccuacgacuacccgaaguacuccgaggaggccaagcugaaccgggaggagaucgacggcgugaagcuggagucgacccgcaucuaccagauccucgcgaucuacagcaccgucgccuccucgcuggugcugguggucucccucggggccaucagcuucuggaugugcuccaacggcagccugcagugccggaucugcaucuga

SEQ ID NO: 6054 - RNA, 1701 nt, Artificial Sequence; identical to SEQ ID NO: 3361
  derived and/or modified CDS sequence (AUadapt) from InfluenzaA__ADM33395__HA

SEQ ID NO: 6055 - RNA, 1701 nt, Artificial Sequence; identical to SEQ ID NO: 3361
  derived and/or modified CDS sequence (AUadapt) from InfluenzaA__ADM33405__HA

SEQ ID NO: 6056 - RNA, 1701 nt, Artificial Sequence; identical to SEQ ID NO: 6050
  derived and/or modified CDS sequence (AUadapt) from InfluenzaA__ADM33415__HA

SEQ ID NO: 6057 - RNA, 1701 nt, Artificial Sequence; identical to SEQ ID NO: 3757
  derived and/or modified CDS sequence (AUadapt) from InfluenzaA__ADM33425__HA

SEQ ID NO: 6058 - RNA, 1701 nt, Artificial Sequence
  derived and/or modified CDS sequence (AUadapt) from InfluenzaA__ADM34007__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccuggaggagcccggggacaagaucaccuucgaggcgaccggcaaccucguggugccccgguacgccuucgccauggagcgcaacgccggguccggcaucaucaucucggacacgcccguccacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgagccugguccucguggugucccugggggccaucucguucuggaugugcuccaacggcagccugcagugccggaucugcaucuga

SEQ ID NO: 6059 - RNA, 1701 nt, Artificial Sequence; identical to SEQ ID NO: 116
  derived and/or modified CDS sequence (AUadapt) from InfluenzaA__ADM52443__HA

SEQ ID NO: 6060 - RNA, 1701 nt, Artificial Sequence
  derived and/or modified CDS sequence (AUadapt) from InfluenzaA__ADM52453__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccucguccuggagcuacaucguggagaccuccucguccgacaacggcacgugcuaccccggcgacuucaucgacuacgaggagcugcgggagcagcucagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcuggugaagaaggggaacagcuaccccaagcucuccaagucguacaucaacgacaagggcaaggaggugcugguccugugggggauccaccaccccagcaccuccgccgaccagcagucgcucuaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggucgggcaucaucaucuccgacacccccauccacgacugcaacacgaccugccagaccccgaagggcgccaucaacaccagccuccccuuccagaacgugcaccccaucacgaucgggaagugccccaaguacgugaaguccaccaagcugcggcuggcgaccggccuccgcaacgucccgucgauccagucccgggggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacucggucaucgagaagaugaacacccaguucaccgccgugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcuggaguccacccgcaucuaccagauccucgcgaucuacagcaccgucgccucgucccuggugcugguggucagccucggggccaucuccuucuggaugugcagcaacggcucccugcagugccggaucugcaucuga

SEQ ID NO: 6061 - RNA, 1701 nt, Artificial Sequence
  derived and/or modified CDS sequence (AUadapt) from InfluenzaA__ADM52473__HA
augaaggccauccuggccgugcuccuguacaccuucgcgaccgccaacgccgacacgcugugcaucggcuaccacgccaacaacucgaccgacaccgucgacaccgugcucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagucgcuguccaccgccagcuccuggucguacaucgucgagaccuccagcuccggcaacggcacgugcuaccccggggacuucaucgacuacgaggagcuccgggagcagcugucguccgugagcuccuucgagcgcuucgagaucuuccccaagaccucguccuggcccaaccacgacucgaacaagggcgugaccgccgccugcccgcacgcgggggccaaguccuucuacaagaaccugcucuggcuggucaagaagggcaacagcuaccccaagcuguccaagucguacaucaacgacaaggggaaggaggugcucgugcuguggggcauccaccaccccagcaccuccgccgaccagcagucgcuguaccagaacgccgacgccuacgucuucgugggcacgucccgguacagcaagaaguucaagcccgagaucgcgauccgcccgaaggugcgggaccaggaggggcgcaugaacuacuacuggacccucgucggccccggggacaagaucaccuucgaggccaccggcaaccugguggugccccgguacgccuucgccauggagcgcaacgccggcuccgggaucaucaucucggacacgcccguccacgacugcaacacgaccugccagaccccgaagggcgcgaucaacaccucccugcccuuccagaacauccaccccaucaccaucgggaagugccccaaguacgucaagagcaccaagcuccggcuggccaccggccugcgcaacgugccguccauccagucgcgggggcuguucggcgccaucgccggcuucaucgagggcggguggacggggaugguggacggcugguacggguaccaccaccagaacgagcagggcuccggcuacgccgcggaccucaagucgacccagaacgccaucgacgagaucaccaacaaggugaacuccgugaucgagaagaugaacacccaguucacggccgucgggaaggaguucaaccaccuggagaagcgcaucgagaaccucaacaagaagguggacgacggcuuccuggacaucuggaccuacaacgccgagcugcucguccugcuggagaacgagcggacccucgacuaccacgacagcaacgugaagaaccuguacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggcgaagcucaaccgggaggagaucgacggcgugaagcuggagagcacccgcaucuaccagauccuggccaucuacuccaccguggccucgagccucguccugguggugucccugggcgccaucucguucuggaugugcuccaacgggagccuccagugccggaucugcaucuga

SEQ ID NO: 6062 - RNA, 1701 nt, Artificial Sequence; identical to SEQ ID NO: 4078
  derived and/or modified CDS sequence (AUadapt) from InfluenzaA__ADM52483__HA

SEQ ID NO: 6063 - RNA, 1701 nt, Artificial Sequence; identical to SEQ ID NO: 96
  derived and/or modified CDS sequence (AUadapt) from InfluenzaA__ADM52493__HA

SEQ ID NO: 6064 - RNA, 1701 nt, Artificial Sequence; identical to SEQ ID NO: 96
  derived and/or modified CDS sequence (AUadapt) from InfluenzaA__ADM52513__HA

SEQ ID NO: 6065 - RNA, 1701 nt, Artificial Sequence; identical to SEQ ID NO: 96
  derived and/or modified CDS sequence (AUadapt) from InfluenzaA__ADM52524__HA

SEQ ID NO: 6066 - RNA, 1701 nt, Artificial Sequence; identical to SEQ ID NO: 96
  derived and/or modified CDS sequence (AUadapt) from InfluenzaA__ADM52534__HA

SEQ ID NO: 6067 - RNA, 1701 nt, Artificial Sequence; identical to SEQ ID NO: 96
  derived and/or modified CDS sequence (AUadapt) from InfluenzaA__ADM52554__HA

SEQ ID NO: 6068 - RNA, 1701 nt, Artificial Sequence; identical to SEQ ID NO: 96
  derived and/or modified CDS sequence (AUadapt) from InfluenzaA__ADM52564__HA

SEQ ID NO: 6069 - RNA, 1701 nt, Artificial Sequence; identical to SEQ ID NO: 62
  derived and/or modified CDS sequence (AUadapt) from InfluenzaA__ADM52574__HA

SEQ ID NO: 6070 - RNA, 1701 nt, Artificial Sequence; identical to SEQ ID NO: 116
  derived and/or modified CDS sequence (AUadapt) from InfluenzaA__ADM52584__HA

SEQ ID NO: 6071 - RNA, 1701 nt, Artificial Sequence
  derived and/or modified CDS sequence (AUadapt) from InfluenzaA__ADM52594__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacguccaaguacucgaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggcgaucuacuccaccgucgccucgagccuggugcucguggucucccugggggccaucucguucuggaugugcuccaacggcagccugcagugccgcaucugcaucuga

SEQ ID NO: 6072 - RNA, 1701 nt, Artificial Sequence; identical to SEQ ID NO: 96
  derived and/or modified CDS sequence (AUadapt) from InfluenzaA__ADM52604__HA

SEQ ID NO: 6073 - RNA, 1701 nt, Artificial Sequence; identical to SEQ ID NO: 96
  derived and/or modified CDS sequence (AUadapt) from InfluenzaA__ADM52614__HA

SEQ ID NO: 6074 - RNA, 1701 nt, Artificial Sequence; identical to SEQ ID NO: 4686
  derived and/or modified CDS sequence (AUadapt) from InfluenzaA__ADM52624__HA

SEQ ID NO: 6075 - RNA, 1701 nt, Artificial Sequence; identical to SEQ ID NO: 96
  derived and/or modified CDS sequence (AUadapt) from InfluenzaA__ADM52634__HA

SEQ ID NO: 6076 - RNA, 1701 nt, Artificial Sequence; identical to SEQ ID NO: 96
  derived and/or modified CDS sequence (AUadapt) from InfluenzaA__ADM52644__HA

SEQ ID NO: 6077 - RNA, 1701 nt, Artificial Sequence; identical to SEQ ID NO: 96
  derived and/or modified CDS sequence (AUadapt) from InfluenzaA__ADM52654__HA

SEQ ID NO: 6078 - RNA, 1701 nt, Artificial Sequence; identical to SEQ ID NO: 4502
  derived and/or modified CDS sequence (AUadapt) from InfluenzaA__ADM52664__HA

SEQ ID NO: 6079 - RNA, 1701 nt, Artificial Sequence; identical to SEQ ID NO: 4686
  derived and/or modified CDS sequence (AUadapt) from InfluenzaA__ADM52674__HA

SEQ ID NO: 6080 - RNA, 1701 nt, Artificial Sequence; identical to SEQ ID NO: 96
  derived and/or modified CDS sequence (AUadapt) from InfluenzaA__ADM52684__HA

SEQ ID NO: 6081 - RNA, 1701 nt, Artificial Sequence; identical to SEQ ID NO: 4686
  derived and/or modified CDS sequence (AUadapt) from InfluenzaA__ADM52704__HA

SEQ ID NO: 6082 - RNA, 1701 nt, Artificial Sequence; identical to SEQ ID NO: 4502
  derived and/or modified CDS sequence (AUadapt) from InfluenzaA__ADM52714__HA

SEQ ID NO: 6083 - RNA, 1701 nt, Artificial Sequence
  derived and/or modified CDS sequence (AUadapt) from InfluenzaA__ADM86399__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccagcuccgacaacggcacgugcuaccccggcgacuucaucgacuacgaggagcugcgggagcagcucucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcuggugaagaaggggaacucguaccccaagcucuccaagagcuacaucaacgacaagggcaaggaggugcugguccugugggggauccaccaccccucgaccuccgccgaccagcagagccucuaccagaacgccgacgccuacguguucgugggcuccucgcgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggagcggcaucaucaucuccgacacccccgugcacgacugcaacacgaccugccagaccccgaagggcgccgugaacaccucgcuccccuuccagaacauccaccccaucacgaucgggaagugccccaaguacgucaaguccaccaagcugcggcuggcgaccggccuccgcaacgugccgagcauccagucccgggggcuguucggcgccaucgccggguucaucgagggcggcuggaccgggaugguggacggcugguacggguaccaccaccagaacgagcagggcucgggguacgccgccgaccugaaguccacgcagaacgcgaucgacgagaucaccaacaaggucaacagcgugaucgagaagaugaacacccaguucaccgccgucggcaaggaguucaaccaccucgagaagcgcaucgagaaccugaacaagaagguggacgacggcuuccuggacaucuggacguacaacgccgagcuccuggugcugcucgagaacgagcggacccuggacuaccacgacuccaacgucaagaaccuguacgagaaggugcgcucgcagcucaagaacaacgccaaggagguggggaacggcugcuucgaguucuaccacaagugcgacaacacgugcauggaguccgucaagaacgggaccuacgacuaccccaaguacagcgaggaggccaagcugaaccgggaggagaucgacggcgugaagcuggaguccacccgcaucuaccagauccucgcgaucuacucgaccgccgccagcucccuggugcuggucgugucgcucggggccaucuccuucuggaugugcagcaacggcucccugcagugccggaucugcaucuga

SEQ ID NO: 6084 - RNA, 1701 nt, Artificial Sequence; identical to SEQ ID NO: 116
  derived and/or modified CDS sequence (AUadapt) from InfluenzaA__ADM86409__HA

SEQ ID NO: 6085 - RNA, 1701 nt, Artificial Sequence; identical to SEQ ID NO: 116
  derived and/or modified CDS sequence (AUadapt) from InfluenzaA__ADM86419__HA

SEQ ID NO: 6086 - RNA, 1701 nt, Artificial Sequence; identical to SEQ ID NO: 4563
  derived and/or modified CDS sequence (AUadapt) from InfluenzaA__ADM86440__HA

SEQ ID NO: 6087 - RNA, 1701 nt, Artificial Sequence; identical to SEQ ID NO: 116
  derived and/or modified CDS sequence (AUadapt) from InfluenzaA__ADM86450__HA

SEQ ID NO: 6088 - RNA, 1707 nt, Artificial Sequence; identical to SEQ ID NO: 195
  derived and/or modified CDS sequence (AUadapt) from InfluenzaA__ADM95450__HA

SEQ ID NO: 6089 - RNA, 1701 nt, Artificial Sequence; identical to SEQ ID NO: 116
  derived and/or modified CDS sequence (AUadapt) from InfluenzaA__ADM95745__HA

SEQ ID NO: 6090 - RNA, 1701 nt, Artificial Sequence; identical to SEQ ID NO: 116
  derived and/or modified CDS sequence (AUadapt) from InfluenzaA__ADM95746__HA

SEQ ID NO: 6091 - RNA, 1701 nt, Artificial Sequence; identical to SEQ ID NO: 116
  derived and/or modified CDS sequence (AUadapt) from InfluenzaA__ADM95747__HA

SEQ ID NO: 6092 - RNA, 1701 nt, Artificial Sequence; identical to SEQ ID NO: 116
  derived and/or modified CDS sequence (AUadapt) from InfluenzaA__ADM95749__HA

SEQ ID NO: 6093 - RNA, 1701 nt, Artificial Sequence
  derived and/or modified CDS sequence (AUadapt) from InfluenzaA__ADM95750__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccuucaaccugcuggaggacaagcacaacgggaagcucugcaagcugcgcggcguggcgccccugcaccucgggaagugcaacaucgccggcuggauccuggggaacccggagugcgagagccuguccaccgccucguccuggagcuacaucgucgagaccuccucguccgacaacggcacgugcuaccccggcgacuucaucgacuacgaggagcuccgggagcagcugagcuccgugagcuccuucgagcgcuucgagaucuuccccaagaccucguccuggcccaaccacgacagcaacaagggggugaccgccgccugcccgcacgccggcgcgaaguccuucuacaagaaccugaucuggcucgucaagaaggggucguccuaccccaagcugagcaagucguacaucaacgacaagggcaaggaggugcuggugcucugggggauccaccaccccuccaccagcgccgaccagcagucccuguaccagaacgccgacgccuacgucuucgugggcagcucccgguacucgaagaaguucaagcccgagaucgccauccgcccgaaggugcgggaccaggagggccgcaugaacuacuacuggacgcuggucgagcccggggacaagaucaccuucgaggcgaccggcaaccucguggugccccgguacgccuucgccauggagcgcaacgccggguccggcaucaucaucagcgacacccccguccacgacugcaacacgaccugccagaccccgaagggcgccaucaacaccucccugcccuuccagaacauccaccccaucacgaucgggaagugccccaaguacgucaagucgaccaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagucgacgcagaacgcgaucgacgagaucaccaacaaggugaacuccgugaucgagaagaugaacacccaguucaccgccgucggcaaggaguucaaccaccuggagaagcgcaucgagaaccugaacaagaagguggacgacggcuuccucgacaucuggacguacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagucgacccgcaucuaccagauccuggcgaucuacagcaccguggccuccucgcugguccucguggugucccugggggccaucagcuucuggaugugcuccaacggcagccugcagugccggaucugcaucuga

SEQ ID NO: 6094 - RNA, 1701 nt, Artificial Sequence; identical to SEQ ID NO: 116
  derived and/or modified CDS sequence (AUadapt) from InfluenzaA__ADM95751__HA

SEQ ID NO: 6095 - RNA, 1701 nt, Artificial Sequence; identical to SEQ ID NO: 116
  derived and/or modified CDS sequence (AUadapt) from InfluenzaA__ADM95752__HA

SEQ ID NO: 6096 - RNA, 1701 nt, Artificial Sequence; identical to SEQ ID NO: 116
  derived and/or modified CDS sequence (AUadapt) from InfluenzaA__ADM95753__HA

SEQ ID NO: 6097 - RNA, 1701 nt, Artificial Sequence; identical to SEQ ID NO: 116
  derived and/or modified CDS sequence (AUadapt) from InfluenzaA__ADM95754__HA

SEQ ID NO: 6098 - RNA, 1701 nt, Artificial Sequence; identical to SEQ ID NO: 116
  derived and/or modified CDS sequence (AUadapt) from InfluenzaA__ADM95755__HA

SEQ ID NO: 6099 - RNA, 1701 nt, Artificial Sequence; identical to SEQ ID NO: 96
  derived and/or modified CDS sequence (AUadapt) from InfluenzaA__ADM95757__HA

SEQ ID NO: 6100 - RNA, 1701 nt, Artificial Sequence; identical to SEQ ID NO: 116
  derived and/or modified CDS sequence (AUadapt) from InfluenzaA__ADM95758__HA

SEQ ID NO: 6101 - RNA, 1701 nt, Artificial Sequence
  derived and/or modified CDS sequence (AUadapt) from InfluenzaA__ADM95759__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacuacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgacccgcaucuaccagauccuggcgaucuacuccaccgucgccagcucgcuggugcucguggucucccugggggccaucagcuucuggaugugcuccaacggcagccugcagugccggaucugcaucuga

SEQ ID NO: 6102 - RNA, 1701 nt, Artificial Sequence; identical to SEQ ID NO: 62
  derived and/or modified CDS sequence (AUadapt) from InfluenzaA__ADM95760__HA

SEQ ID NO: 6103 - RNA, 1701 nt, Artificial Sequence; identical to SEQ ID NO: 116
  derived and/or modified CDS sequence (AUadapt) from InfluenzaA__ADM95761__HA

SEQ ID NO: 6104 - RNA, 1701 nt, Artificial Sequence
  derived and/or modified CDS sequence (AUadapt) from InfluenzaA__ADM95763__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagaacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 6105 - RNA, 1701 nt, Artificial Sequence; identical to SEQ ID NO: 116
  derived and/or modified CDS sequence (AUadapt) from InfluenzaA__ADM95764__HA

SEQ ID NO: 6106 - RNA, 1701 nt, Artificial Sequence; identical to SEQ ID NO: 116
  derived and/or modified CDS sequence (AUadapt) from InfluenzaA__ADM95765__HA

SEQ ID NO: 6107 - RNA, 1701 nt, Artificial Sequence; identical to SEQ ID NO: 116
  derived and/or modified CDS sequence (AUadapt) from InfluenzaA__ADM95767__HA

SEQ ID NO: 6108 - RNA, 1701 nt, Artificial Sequence; identical to SEQ ID NO: 3757
  derived and/or modified CDS sequence (AUadapt) from InfluenzaA__ADM95768__HA

SEQ ID NO: 6109 - RNA, 1701 nt, Artificial Sequence; identical to SEQ ID NO: 3267
  derived and/or modified CDS sequence (AUadapt) from InfluenzaA__ADM95769__HA

SEQ ID NO: 6110 - RNA, 1701 nt, Artificial Sequence; identical to SEQ ID NO: 5030
  derived and/or modified CDS sequence (AUadapt) from InfluenzaA__ADM95771__HA

SEQ ID NO: 6111 - RNA, 1701 nt, Artificial Sequence; identical to SEQ ID NO: 116
  derived and/or modified CDS sequence (AUadapt) from InfluenzaA__ADM95772__HA

SEQ ID NO: 6112 - RNA, 1701 nt, Artificial Sequence; identical to SEQ ID NO: 116
  derived and/or modified CDS sequence (AUadapt) from InfluenzaA__ADM95774__HA

SEQ ID NO: 6113 - RNA, 1701 nt, Artificial Sequence; identical to SEQ ID NO: 116
  derived and/or modified CDS sequence (AUadapt) from InfluenzaA__ADM95775__HA

SEQ ID NO: 6114 - RNA, 1701 nt, Artificial Sequence; identical to SEQ ID NO: 3267
  derived and/or modified CDS sequence (AUadapt) from InfluenzaA__ADM95776__HA

SEQ ID NO: 6115 - RNA, 1701 nt, Artificial Sequence; identical to SEQ ID NO: 3267
  derived and/or modified CDS sequence (AUadapt) from InfluenzaA__ADM95778__HA

SEQ ID NO: 6116 - RNA, 1701 nt, Artificial Sequence
  derived and/or modified CDS sequence (AUadapt) from InfluenzaA__ADM95779__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacaucccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacucgaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagcccacccgcaucuaccagauccuggcgaucuacucgaccguggccuccagccugguccucguggugucgcugggggccaucuccuucuggaugugcagcaacggcucccugcagugccggaucugcaucuga

SEQ ID NO: 6117 - RNA, 1701 nt, Artificial Sequence; identical to SEQ ID NO: 3267
  derived and/or modified CDS sequence (AUadapt) from InfluenzaA__ADM95780__HA

SEQ ID NO: 6118 - RNA, 1701 nt, Artificial Sequence; identical to SEQ ID NO: 3757
  derived and/or modified CDS sequence (AUadapt) from InfluenzaA__ADM95783__HA

SEQ ID NO: 6119 - RNA, 1701 nt, Artificial Sequence; identical to SEQ ID NO: 116
  derived and/or modified CDS sequence (AUadapt) from InfluenzaA__ADM95784__HA

SEQ ID NO: 6120 - RNA, 1701 nt, Artificial Sequence; identical to SEQ ID NO: 116
  derived and/or modified CDS sequence (AUadapt) from InfluenzaA__ADM95785__HA

SEQ ID NO: 6121 - RNA, 1701 nt, Artificial Sequence
  derived and/or modified CDS sequence (AUadapt) from InfluenzaA__ADM95786__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcucccacgccggcgccaagagcuucuacaagaaccugaucuggcucgugaagaaggggaacuccuacccgaagcugucgaagagcuacaucaacgacaagggcaaggaggugcugguccucugggggauccaccaccccuccaccucggccgaccagcagucccuguaccagaacgccgacgccuacguguucgugggcacgagccgguacuccaagaaguucaagcccgagaucgccauccgccccaagguccgggagcaggagggccgcaugaacuacuacuggacccugguggagccgggggacaagaucaccuucgaggcgaccggcaaccucguggucccccgguacgccuucgccauggagcgcaacgccgggucgggcaucaucaucuccgacacgcccgugcacgacugcaacacgaccugccagacccccaagggcgccaucaacaccagccugccguuccagaacauccaccccaucaccaucgggaagugccccaaguacgugaaguccaccaagcugcggcucgcgaccggccugcgcaacguccccucgauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacucggucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuacccgaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 6122 - RNA, 1701 nt, Artificial Sequence; identical to SEQ ID NO: 3267
  derived and/or modified CDS sequence (AUadapt) from InfluenzaA__ADM95788__HA

SEQ ID NO: 6123 - RNA, 1701 nt, Artificial Sequence; identical to SEQ ID NO: 3267
  derived and/or modified CDS sequence (AUadapt) from InfluenzaA__ADM95789__HA

SEQ ID NO: 6124 - RNA, 1701 nt, Artificial Sequence
  derived and/or modified CDS sequence (AUadapt) from InfluenzaA__ADM95790__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcugcggaaguccuacaucaacgacaagggcaaggaggugcugguccucugggggauccaccaccccagcaccucggccgaccagcagucccuguaccagaacgccgacgccuacguguucgugggcacgucgcgcuacuccaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccgggagcggcaucaucaucuccgacacgcccgugcacgacugcaacacgaccugccagaccccgaagggcgccaucaacaccucgcugcccuuccagaacauccaccccaucaccaucgggaagugccccaaguacgugaaguccaccaagcugcgccucgcgaccggccugcggaacaucccgagcauccagucccgcgggcuguucggcgccaucgccggguucaucgagggcggcuggacggggauggucgacggcugguacggguaccaccaccagaacgagcagggcucgggguacgccgccgaccucaaguccacccagaacgcgaucgacgagaucaccaacaaggugaacagcgugaucgagaagaugaacacccaguucacggccgucggcaaggaguucaaccaccuggagaagcggaucgagaaccugaacaagaagguggacgacggcuuccucgacaucuggaccuacaacgccgagcugcugguccuccuggagaacgagcgcacccuggacuaccacgacuccaacgugaagaaccucuacgagaaggugcggucgcagcugaagaacaacgccaaggagaucgggaacggcugcuucgaguucuaccacaagugcgacaacacgugcauggaguccgucaagaacgggaccuacgacuaccccaaguacagcgaggaggccaagcugaaccgcgaggagaucgacggcgugaagcucgaguccacccggaucuaccagauccuggcgaucuacucgaccguggccuccagccugguccucguggugucgcugggggccaucuccuucuggaugugcagcaacggcucccugcagugccgcaucugcaucuga

SEQ ID NO: 6125 - RNA, 1701 nt, Artificial Sequence; identical to SEQ ID NO: 6124
  derived and/or modified CDS sequence (AUadapt) from InfluenzaA__ADM95791__HA

SEQ ID NO: 6126 - RNA, 1701 nt, Artificial Sequence; identical to SEQ ID NO: 6124
  derived and/or modified CDS sequence (AUadapt) from InfluenzaA__ADM95792__HA

SEQ ID NO: 6127 - RNA, 1701 nt, Artificial Sequence; identical to SEQ ID NO: 5511
  derived and/or modified CDS sequence (AUadapt) from InfluenzaA__ADM95793__HA

SEQ ID NO: 6128 - RNA, 1701 nt, Artificial Sequence; identical to SEQ ID NO: 3267
  derived and/or modified CDS sequence (AUadapt) from InfluenzaA__ADM95794__HA

SEQ ID NO: 6129 - RNA, 1701 nt, Artificial Sequence; identical to SEQ ID NO: 116
  derived and/or modified CDS sequence (AUadapt) from InfluenzaA__ADM95795__HA

SEQ ID NO: 6130 - RNA, 1701 nt, Artificial Sequence; identical to SEQ ID NO: 4016
  derived and/or modified CDS sequence (AUadapt) from InfluenzaA__ADM95798__HA

SEQ ID NO: 6131 - RNA, 1701 nt, Artificial Sequence
  derived and/or modified CDS sequence (AUadapt) from InfluenzaA__ADM95799__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgagaacgggugcuucgaguucuaccacaagugcgacaacacgugcauggagucggugaagaacggcaccuacgacuaccccaaguacuccgaggaggccaagcugaaccgggaggagaucgacggggugaagcucgagagcacccgcaucuaccagauccuggcgaucuacuccaccgucgccucgagccuggugcucguggucucccugggcgccaucucguucuggaugugcuccaacgggagccugcagugccggaucugcaucuga

SEQ ID NO: 6132 - RNA, 1701 nt, Artificial Sequence
  derived and/or modified CDS sequence (AUadapt) from InfluenzaA__ADM95800__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggcgcccggggacaagaucaccuucgaggccaccggcaaccucguggucccccgguacgccuucgccauggagcgcaacgccggguccggcaucaucaucagcgacacgcccgugcacgacugcaacacgaccugccagaccccgaagggcgcgaucaacaccucccugcccuuccagaacauccaccccaucaccaucgggaagugccccaaguacgucaagucgaccaagcugcggcucgccaccggccugcgcaacgugccguccauccagagccgggggcuguucggcgccaucgccggguucaucgagggcggcuggacggggaugguggacggcugguacggguaccaccaccagaacgagcagggcuccggguacgccgcggaccucaagucgacccagaacgccaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggcgaagcugaaccgggaggagaucgacggcgugaagcucgagagcacccgcaucuaccagauccuggccaucuacuccaccgucgccucgagccuggugcucguggucucccugggggccaucucguucuggaugugcuccaacggcagccugcagugccggaucugcaucuga

SEQ ID NO: 6133 - RNA, 1701 nt, Artificial Sequence; identical to SEQ ID NO: 3267
  derived and/or modified CDS sequence (AUadapt) from InfluenzaA__ADM95801__HA

SEQ ID NO: 6134 - RNA, 1701 nt, Artificial Sequence; identical to SEQ ID NO: 3267
  derived and/or modified CDS sequence (AUadapt) from InfluenzaA__ADM95802__HA

SEQ ID NO: 6135 - RNA, 1701 nt, Artificial Sequence; identical to SEQ ID NO: 6121
  derived and/or modified CDS sequence (AUadapt) from InfluenzaA__ADM95803__HA

SEQ ID NO: 6136 - RNA, 1701 nt, Artificial Sequence
  derived and/or modified CDS sequence (AUadapt) from InfluenzaA__ADM95804__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaagaacuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacguguucgugggcacgucgcgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccucgcugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcucgggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaagcucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 6137 - RNA, 1701 nt, Artificial Sequence; identical to SEQ ID NO: 4596
  derived and/or modified CDS sequence (AUadapt) from InfluenzaA__ADM95805__HA

SEQ ID NO: 6138 - RNA, 1701 nt, Artificial Sequence; identical to SEQ ID NO: 4015
  derived and/or modified CDS sequence (AUadapt) from InfluenzaA__ADM95808__HA

SEQ ID NO: 6139 - RNA, 1701 nt, Artificial Sequence; identical to SEQ ID NO: 4015
  derived and/or modified CDS sequence (AUadapt) from InfluenzaA__ADM95809__HA

SEQ ID NO: 6140 - RNA, 1701 nt, Artificial Sequence; identical to SEQ ID NO: 4015
  derived and/or modified CDS sequence (AUadapt) from InfluenzaA__ADM95810__HA

SEQ ID NO: 6141 - RNA, 1701 nt, Artificial Sequence
  derived and/or modified CDS sequence (AUadapt) from InfluenzaA__ADM95812__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagcugcucagcaccgcguccucgugguccuacaucguggagaccagcuccucggacaacggcacgugcuaccccggcgacuucaucgacuacgaggagcugcgggagcagcuguccagcguguccucguucgagcgcuucgagaucuuccccaagaccuccagcuggcccaaccacgacuccaacaagggggucaccgccgccugcccgcacgccggcgccaagucguucuacaagaaccucaucuggcuggugaagaaggggaacuccuaccccaagcugagcaaguccuacaucaacgacaagggcaaggaggugcucguccugugggggauccaccaccccucgaccagcgccgaccagcagucccuguaccagaacgccgacgccuacguguucgugggcacgucgcgguacuccaagaaguucaagcccgagaucgccauccgcccgaagguccgggaccaggagggccgcaugaacuacuacuggacccucguggagcccggggacaagaucaccuucgaggcgaccggcaaccugguggucccccgguacgccuucgccauggagcgcaacgccgggagcggcaucaucaucuccgacacgcccgugcacgacugcaacacgaccugccagaccccgaagggcgccaucaacaccucgcugcccuuccagaacauccaccccaucaccaucgggaagugccccaaguacgugaaguccaccaagcuccggcuggcgaccggccugcgcaacgucccgagcauccagucccggggccucuucggggccaucgccggguucaucgagggcggcuggacggggaugguggacggcugguacggguaccaccaccagaacgagcagggcucgggguacgccgccgaccugaaguccacccagaacgcgaucgacgagaucaccaacaaggugaacagcgucaucgagaagaugaacacccaguucacggccgugggcaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacuccaacgugaagaaccuguacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcucaaccgggaggagaucgacggcgugaagcuggaguccacccgcaucuaccagauccuggcgaucuacucgaccgucgccuccagccucgugcugguggucucgcugggggccaucuccuucuggaugugcagcaacggcucccuccagugccggaucugcaucuga

SEQ ID NO: 6142 - RNA, 1701 nt, Artificial Sequence; identical to SEQ ID NO: 5511
  derived and/or modified CDS sequence (AUadapt) from InfluenzaA__ADM95816__HA

SEQ ID NO: 6143 - RNA, 1701 nt, Artificial Sequence; identical to SEQ ID NO: 5511
  derived and/or modified CDS sequence (AUadapt) from InfluenzaA__ADM95819__HA

SEQ ID NO: 6144 - RNA, 1701 nt, Artificial Sequence; identical to SEQ ID NO: 4596
  derived and/or modified CDS sequence (AUadapt) from InfluenzaA__ADM95820__HA

SEQ ID NO: 6145 - RNA, 1701 nt, Artificial Sequence; identical to SEQ ID NO: 5511
  derived and/or modified CDS sequence (AUadapt) from InfluenzaA__ADM95821__HA

SEQ ID NO: 6146 - RNA, 1701 nt, Artificial Sequence; identical to SEQ ID NO: 4015
  derived and/or modified CDS sequence (AUadapt) from InfluenzaA__ADM95822__HA

SEQ ID NO: 6147 - RNA, 1701 nt, Artificial Sequence; identical to SEQ ID NO: 4015
  derived and/or modified CDS sequence (AUadapt) from InfluenzaA__ADM95823__HA

SEQ ID NO: 6148 - RNA, 1701 nt, Artificial Sequence
  derived and/or modified CDS sequence (AUadapt) from InfluenzaA__ADM95824__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuaccacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggauggcgaccggccuccgcaacgugccguccauccagucgcgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcuggagagcacccgcaucuaccagauccucgcgaucuacuccaccgucgccucgagccuggugcugguggucucccucggggccaucucguucuggaugugcuccaacggcagccugcagugccggaucugcaucuga

SEQ ID NO: 6149 - RNA, 1701 nt, Artificial Sequence; identical to SEQ ID NO: 5511
  derived and/or modified CDS sequence (AUadapt) from InfluenzaA__ADM95825__HA

SEQ ID NO: 6150 - RNA, 1701 nt, Artificial Sequence; identical to SEQ ID NO: 5511
  derived and/or modified CDS sequence (AUadapt) from InfluenzaA__ADM95826__HA

SEQ ID NO: 6151 - RNA, 1701 nt, Artificial Sequence
  derived and/or modified CDS sequence (AUadapt) from InfluenzaA__ADM95827__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugaagggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgcgagcagcugucguccgugagcuccuucgagcgguucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgcuacucgaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagcacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggcgaucuacuccaccgucgccucgagccuggugcucguggucucccugggggccaucucguucuggaugugcuccaacggcagccugcagugccgcaucugcaucuga

SEQ ID NO: 6152 - RNA, 1701 nt, Artificial Sequence
  derived and/or modified CDS sequence (AUadapt) from InfluenzaA__ADM95828__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgcccacgacugcaacacgaccugccagaccccgaagggcgcgaucaacaccucccugcccuuccagaacauccaccccaucaccaucgggaagugccccaaguacgucaagagcaccaagcugcggauggccaccggccuccgcaacgugccguccauccagucgcgggggcuguucggcgccaucgccggguucaucgagggcggcuggacggggaugguggacggcugguacggguaccaccaccagaacgagcagggcuccggguacgccgcggaccucaagucgacccagaacgccaucgacgagaucaccaacaaggugaacuccgugaucgagaagaugaacacccaguucacggccgucggcaaggaguucaaccaccuggagaagcgcaucgagaaccugaacaagaagguggacgacggcuuccuggacaucuggaccuacaacgccgagcuccugguccugcucgagaacgagcggacccuggacuaccacgacagcaacgugaagaaccuguacgagaaggugcgcucccagcucaagaacaacgccaaggagaucgggaacggcugcuucgaguucuaccacaagugcgacaacacgugcauggagucggucaagaacgggaccuacgacuaccccaaguacuccgaggaggcgaagcugaaccgggaggagaucgacggcgugaagcuggagagcacccgcaucuaccagauccucgccaucuacuccaccguggccucgagccugguccugguggugucccucggggccaucucguucuggaugugcuccaacggcagccugcagugccggaucugcaucuga

SEQ ID NO: 6153 - RNA, 1701 nt, Artificial Sequence
  derived and/or modified CDS sequence (AUadapt) from InfluenzaA__ADM95829__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaagcucuacgagaagguccgcucccagcugaagaacaacgccaaggagaucgggaacggcugcuucgaguucuaccacaagugcgacaacaugugcauggagagcgugaagaacgggaccuacgacuaccccaaguacuccgaggaggccaagcugaaccgggaggagaucgacggcgugaagcucgagucgacgcgcaucuaccagauccuggcgaucuacuccaccgucgccagcucgcuggugcucguggucucccugggggccaucagcuucuggaugugcuccaacggcagccugcagugccggaucugcaucuga

SEQ ID NO: 6154 - RNA, 1701 nt, Artificial Sequence
  derived and/or modified CDS sequence (AUadapt) from InfluenzaA__ADM95831__HA
augaaggccauccuggugguccuccuguacaccuucgugaccgccaacgcggacacgcugugcaucggcuaccacgccaacaacucgaccgacaccguggacaccguccucgagaagaacgugacggugacccacuccgucaaccugcuggaggacaagcacaacgggaagcucugcaagcugcgcggcguggcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgucucguccuucgagcgcuucgagaucuuccccaagaccagcuccuggcccaaccacgacucgaacaagggggugaccgccgccugcccgcacgccggcgccaaguccuucuacaagaaccugaucuggcucgugaagaaggggaacagcuaccccaagcuguccaagucguacaucaacgacaagggcaaggagguccuggugcucugggggauccaccaccccagcaccuccgcggaccagcagucgcuguaccagaacgccgacgccuacguguucgucggcacgucccgguacagcaagaaguucaagcccgagaucgccauccgcccgaaggugcgggaccaggagggccgcaugaacuacuacuggacccugguggagcccggggacaagaucaccuucgaggccaccggcaaccucgucgugccccgguacgcguucgccauggagaagaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcgccucgccaccggccugcggaacgugccguccauccagucgcgcgggcuguucggcgcgaucgccggguucaucgagggcggcuggacggggaugguggacggcugguacggguaccaccaccagaacgagcagggcuccggguacgccgccgaccucaagagcacccagcacgccaucgacgagaucaccaacaaggucaacuccgugaucgagaagaugaacacccaguucacggcggucggcaaggaguucaaccaccuggagaagcggaucgagaaccugaacaagaagguggacgacggcuuccucgacaucuggaccuacaacgccgagcugcuggugcuccuggagaacgagcgcacccuggacuaccacgacucgaacgucaagaaccucuacgagaaggugcggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgucaagcucgagucgacccggaucuaccagauccuggccaucuacuccaccguggcgagcucgcuggugcucgucgugucccugggggccaucagcuucuggaugugcuccaacggcagccugcagugccgcaucugcaucuga

SEQ ID NO: 6155 - RNA, 1701 nt, Artificial Sequence; identical to SEQ ID NO: 4015
  derived and/or modified CDS sequence (AUadapt) from InfluenzaA__ADM95832__HA

SEQ ID NO: 6156 - RNA, 1701 nt, Artificial Sequence; identical to SEQ ID NO: 4596
  derived and/or modified CDS sequence (AUadapt) from InfluenzaA__ADM95833__HA

SEQ ID NO: 6157 - RNA, 1701 nt, Artificial Sequence; identical to SEQ ID NO: 6141
  derived and/or modified CDS sequence (AUadapt) from InfluenzaA__ADM95834__HA

SEQ ID NO: 6158 - RNA, 1701 nt, Artificial Sequence; identical to SEQ ID NO: 4596
  derived and/or modified CDS sequence (AUadapt) from InfluenzaA__ADM95836__HA

SEQ ID NO: 6159 - RNA, 1701 nt, Artificial Sequence; identical to SEQ ID NO: 5511
  derived and/or modified CDS sequence (AUadapt) from InfluenzaA__ADM95837__HA

SEQ ID NO: 6160 - RNA, 1701 nt, Artificial Sequence
  derived and/or modified CDS sequence (AUadapt) from InfluenzaA__ADM95838__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugccugcacgccggcgcgaaguccuucuacaagaaccucaucuggcuggugaagaaggggaacagcuacccgaagcuguccaagucguacaucaacgacaagggcaaggaggugcucguccugugggggauccaccaccccagcaccuccgccgaccagcagucgcuguaccagaacgccgacgccuacguguucgugggcacgucccgguacagcaagaaguucaagcccgagaucgccauccgccccaagguccgggaccaggagggccgcaugaacuacuacuggacccucguggagccgggggacaagaucaccuucgaggcgaccggcaaccugguggucccccgguacgccuucgccauggagcgcaacgccggguccggcaucaucaucucggacacgcccgugcacgacugcaacacgaccugccagacccccaagggcgccaucaacaccucccugccguuccagaacauccaccccaucaccaucgggaagugccccaaguacgucaagagcaccaagcuccggcuggcgaccggccugcgcaacgugcccuccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacucgaacgugaagaaccuguacgagaagguccgcucccagcugaagaacaacgccaaggagaucgggaacggcugcuucgaguucuaccacaagugcgacaacacgugcauggagagcgugaagaacgggaccuacgacuacccgaaguacuccgaggaggccaagcucaaccgggaggagaucgacggcgugaagcuggagucgacccgcaucuaccagauccuggcgaucuacuccaccgucgccagcucgcucgugcugguggucucccugggggccaucagcuucuggaugugcuccaacggcagccuccagugccggaucugcaucuga

SEQ ID NO: 6161 - RNA, 1701 nt, Artificial Sequence; identical to SEQ ID NO: 4596
  derived and/or modified CDS sequence (AUadapt) from InfluenzaA__ADM95839__HA

SEQ ID NO: 6162 - RNA, 1701 nt, Artificial Sequence; identical to SEQ ID NO: 6121
  derived and/or modified CDS sequence (AUadapt) from InfluenzaA__ADM95840__HA

SEQ ID NO: 6163 - RNA, 1701 nt, Artificial Sequence; identical to SEQ ID NO: 6121
  derived and/or modified CDS sequence (AUadapt) from InfluenzaA__ADM95842__HA

SEQ ID NO: 6164 - RNA, 1701 nt, Artificial Sequence; identical to SEQ ID NO: 5511
  derived and/or modified CDS sequence (AUadapt) from InfluenzaA__ADM95843__HA

SEQ ID NO: 6165 - RNA, 1701 nt, Artificial Sequence; identical to SEQ ID NO: 5511
  derived and/or modified CDS sequence (AUadapt) from InfluenzaA__ADM95844__HA

SEQ ID NO: 6166 - RNA, 1701 nt, Artificial Sequence
  derived and/or modified CDS sequence (AUadapt) from InfluenzaA__ADM95845__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggauggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagucggugaagaacgggaccuacgacuaccccaaguacuccgaggagaccaagcugaaccgggaggagaucgacggcgugaagcuggagagcacccgcaucuaccagauccucgccaucuacuccaccgucgcgucgagccuggugcugguggucucccucggggccaucucguucuggaugugcuccaacggcagccugcagugccggaucugcaucuga

SEQ ID NO: 6167 - RNA, 1701 nt, Artificial Sequence
  derived and/or modified CDS sequence (AUadapt) from InfluenzaA__ADM95846__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggaggccuccagcuccgacaacgggaccugcuaccccggcgacuucaucgacuacgaggagcuccgggagcagcugucguccgugagcuccuucgagcgcuucgagaucuuccccaagacgucguccuggcccaaccacgacagcaacaagggcgucaccgccgccugcccgcacgcgggcgccaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcaccucccgguacucgaagaaguucaagcccgagaucgcgauccgcccgaagguccgggaccaggagggccgcaugaacuacuacuggacgcugguggagcccggggacaagaucaccuucgaggccaccggcaaccucguggucccccgguacgccuucgccauggagcgcaacgccggguccggcaucaucaucagcgacacccccgugcacgacugcaacacgaccugccagaccccgaagggcgcgaucaacaccucccugcccuuccagaacauccaccccaucacgaucgggaagugccccaaguacgucaagucgaccaagcugcggcucgccaccggccugcgcaacaucccguccauccagagccgggggcuguucggcgccaucgccggguucaucgagggcggcuggaccgggaugguggacggcugguacggguaccaccaccagaacgagcagggcuccggguacgccgcggaccucaagucgacgcagaacgccaucgacgagaucaccaacaaggugaacuccgugaucgagaagaugaacacccaguucaccgccgucggcaaggaguucaaccaccuggagaagcgcaucgagaaccugaacaagaagguggacgacggcuuccucgacaucuggacguacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggcgaagcugaaccgggaggagaucgacggcgugaagcucgagagcacccgcaucuaccagauccuggccaucuacuccaccguggccucgagccugguccucguggugucccugggggccaucucguucuggaugugcuccaacggcagccugcagugccggaucugcaucuga

SEQ ID NO: 6168 - RNA, 1701 nt, Artificial Sequence; identical to SEQ ID NO: 4015
  derived and/or modified CDS sequence (AUadapt) from InfluenzaA__ADM95847__HA

SEQ ID NO: 6169 - RNA, 1701 nt, Artificial Sequence; identical to SEQ ID NO: 4015
  derived and/or modified CDS sequence (AUadapt) from InfluenzaA__ADM95848__HA

SEQ ID NO: 6170 - RNA, 1701 nt, Artificial Sequence
  derived and/or modified CDS sequence (AUadapt) from InfluenzaA__ADM95849__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaagcucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucgugaucucccugggggccaucucguucuggaugugcuccaacggcagccugcagugccggaucugcaucuga

SEQ ID NO: 6171 - RNA, 1701 nt, Artificial Sequence; identical to SEQ ID NO: 5511
  derived and/or modified CDS sequence (AUadapt) from InfluenzaA__ADM95850__HA

SEQ ID NO: 6172 - RNA, 1701 nt, Artificial Sequence
  derived and/or modified CDS sequence (AUadapt) from InfluenzaA__ADM95851__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccaccagcuccuggucguacaucguggagacguccagcuccgacaacgggaccugcuaccccggcgacuucaucgacuacgaggagcuccgggagcagcugucguccgugagcuccuucgagcgcuucgagaucuuccccaagaccucguccuggcccaaccacgacagcaacaagggcgucaccgccgccugcccgcacgccggcgccaaguccuucuacaagaaccugaucuggcucgugaagaaggggaacucguaccccaagcuguccaagagcuacaucaacgacaagggcaaggaggugcugguccucugggggauccaccaccccucgacguccgcggaccagcagagccuguaccagaacgccgacgccuacguguucgugggcaccucccgguacucgaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcggcucgccacgggccugcgcaacaucccguccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacgagaucaccaacaaggugaacuccgugaucgagaagaugaacacgcaguucaccgcggucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggccaucuacuccaccguggcgucgagccugguccucguggugucccugggggccaucucguucuggaugugcuccaacggcagccugcagugccggaucugcaucuga

SEQ ID NO: 6173 - RNA, 1701 nt, Artificial Sequence
  derived and/or modified CDS sequence (AUadapt) from InfluenzaA__ADM95852__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaagcucuacgagaagauccgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgagccugguccucguggugucccugggggccaucucguucuggaugugcuccaacggcagccugcagugccggaucugcaucuga

SEQ ID NO: 6174 - RNA, 1701 nt, Artificial Sequence; identical to SEQ ID NO: 4334
  derived and/or modified CDS sequence (AUadapt) from InfluenzaA__ADM95854__HA

SEQ ID NO: 6175 - RNA, 1701 nt, Artificial Sequence
  derived and/or modified CDS sequence (AUadapt) from InfluenzaA__ADM95855__HA
augaaggccauccuggugguccuccuguacaccuucgccaccacgaacgcggacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagacguccagcuccgacaacgggaccugcuaccccggcgacuucaucgacuacgaggagcuccgggagcagcugucguccgugagcuccuucgagcgcuucgagaucuuccccaagaccucguccuggcccaaccacgacagcaacaagggcgucaccgccgccugcccgcacgccggcgccaaguccuucuacaagaaccugaucuggcucgugaagaaggggaacucguaccccaagcuguccaagagcuacaucaacgacaagggcaaggaggugcugguccucugggggauccaccaccccucgacguccgcggaccagcagagccuguaccagaacgccgacgccuacguguucgugggcaccucccgguacucgaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaagcucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggccaucuacuccaccgucgcgucgagccuggugcucguggucucccugggggccaucucguucuggaugugcuccaacggcagccugcagugccggaucugcaucuga

SEQ ID NO: 6176 - RNA, 1701 nt, Artificial Sequence
  derived and/or modified CDS sequence (AUadapt) from InfluenzaA__ADM95857__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgaacagcugguccuacaucguggagaccucguccagcgacaacggcacgugcuaccccggcgacuucaucgacuacgaggagcuccgggagcagcuguccucgguguccagcuucgagcgcuucgagaucuuccccaagaccuccucguggcccaaccacgacuccaacaagggggucaccgccgccugcccgcacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacguguucgugggcacgucgcgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccucgcugcccuuccagaacauccaccccaucaccaucgggaagugccccaaguacgugaaguccaccaagcugcggauggcgaccggccuccgcaacgucccgagcauccagucccgggggcuguucggcgccaucgccggguucaucgagggcggcuggacggggaugguggacggcugguacggguaccaccaccagaacgagcagggcucgggguacgccgccgaccugaaguccacccagaacgcgaucgacgagaucaccaacaaggugaacagcgucaucgagaagaugaacacccaguucacggccgugggcaaggaguucaaccaccucgagaagcgcaucgagaaccugaacaagaaggucgacgacggcuuccuggacaucuggaccuacaacgccgagcuccuggugcugcucgagaacgagcggacccuggacuaccacgacuccaacgugaagaaccuguacgagaagguccgcucgcagcucaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcuggaguccacccgcaucuaccagauccucgcgaucuacucgaccgucgccuccagccuggugcugguggucucgcucggggccaucuccuucuggaugugcagcaacggcucccugcagugccggaucugcaucuga

SEQ ID NO: 6177 - RNA, 1701 nt, Artificial Sequence; identical to SEQ ID NO: 4596
  derived and/or modified CDS sequence (AUadapt) from InfluenzaA__ADM95858__HA

SEQ ID NO: 6178 - RNA, 1701 nt, Artificial Sequence
  derived and/or modified CDS sequence (AUadapt) from InfluenzaA__ADM95859__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgagaagcucugcaagcugcgcggggucgcgccccugcaccucggcaagugcaacaucgccggguggauccugggcaacccggagugcgagucgcuguccaccgccagcuccuggucguacaucguggagaccuccagcuccgacaacgggacgugcuaccccggcgacuucaucgacuacgaggagcuccgggagcagcugucguccgugagcuccuucgagcgcuucgagaucuuccccaagaccucguccuggcccaaccacgacagcaacaagggcgucaccgccgccugcccgcacgccggggcgaaguccuucuacaagaaccugaucuggcucgugaagaagggcaacucguaccccaagcuguccaagagcuacaucaacgacaaggggaaggaggugcugguccucuggggcauccaccaccccucgaccuccgccgaccagcagagccuguaccagaacgccgacgccuacguguucguggggacgucccgguacucgaagaaguucaagcccgagaucgccauccgcccgaagguccgggaccaggagggccgcaugaacuacuacuggacccugguggagcccggcgacaagaucaccuucgaggcgaccgggaaccucguggucccccgguacgccuucgccauggagcgcaacgccggcuccgggaucaucaucagcgacacgcccgugcacgacugcaacacgaccugccagaccccgaagggcgccaucaacaccucccugcccuuccagaacauccaccccaucaccaucggcaagugccccaaguacgucaagucgaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagucgacccagaacgcgaucgacgagaucaccaacaaggugaacuccgucaucgagaagaugaacacccaguucacggccguggggaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaagcucuacgagaagguccgcucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcucgagagcacccgcaucuaccagauccuggcgaucuacuccaccgucgccucgagccuggugcucguggucucccugggcgccaucucguucuggaugugcuccaacgggagccugcagugccggaucugcaucuga

SEQ ID NO: 6179 - RNA, 1701 nt, Artificial Sequence; identical to SEQ ID NO: 4541
  derived and/or modified CDS sequence (AUadapt) from InfluenzaA__ADM95860__HA

SEQ ID NO: 6180 - RNA, 1701 nt, Artificial Sequence; identical to SEQ ID NO: 6141
  derived and/or modified CDS sequence (AUadapt) from InfluenzaA__ADM95862__HA

SEQ ID NO: 6181 - RNA, 1701 nt, Artificial Sequence
  derived and/or modified CDS sequence (AUadapt) from InfluenzaA__ADM95864__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgcggguccgcgaccaggagggccggaugaacuaccacuggacccugguggagcccggggacaagaucaccuucgaggcgaccggcaaccucguggucccccgcuacgccuucgccauggagcggaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacaucccguccauccagucgcgcgggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgugaucgagaagaugaacacccaguucacggccgucggcaaggaguucaaccaccuggagaagcggaucgagaaccugaacaagaagguggacgacggcuuccucgacaucuggaccuacaacgccgagcugcugguccuccuggagaacgagcgcacccuggacuaccacgacagcaacgugaagaaccucuacgagaaggugcggucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgcgaggagaucgacggcgugaagcucgagagcacccggaucuaccagauccuggcgaucuacuccaccguggccucgagccugguccucguggugucccugggggccaucucguucuggaugugcuccaacggcagccugcagugccgcaucugcaucuga

SEQ ID NO: 6182 - RNA, 1701 nt, Artificial Sequence; identical to SEQ ID NO: 4466
  derived and/or modified CDS sequence (AUadapt) from InfluenzaA__ADM95865__HA

SEQ ID NO: 6183 - RNA, 1701 nt, Artificial Sequence
  derived and/or modified CDS sequence (AUadapt) from InfluenzaA__ADM95866__HA
augaaggccauccuggugguccuccuguacaccuucgccaccacgaacgcggacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaucuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgccaaguccuucuacaagaaccugaucuggcucgugaagaaggggaacagcuaccccaagcuguccaagucguacaucaacgacaagggcaaggaggugcugguccucugggggauccaccaccccagcaccuccgcggaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggccaccggcaaccucguggucccccgguacgcguucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgugaccggccugcgcaacgugccguccauccagucgcgggggcuguucggcgccaucgcgggguucaucgagggcggcuggacggggaugguggacggcugguacggguaccaccaccagaacgagcagggcuccggguacgccgccgaccucaagagcacccagaacgccaucgacaagaucaccaacaaggucaacuccgugaucgagaagaugaacacccaguucacggccgucggcaaggaguucaaccaccuggagaagcgcaucgagaaccugaacaagaagguggacgacggcuuccucgacaucuggaccuacaacgcggagcugcuggugcuccuggagaacgagcggacccuggacuaccacgacucgaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagucgacccgcaucuaccagauccuggccaucuacuccaccgccgcgagcucgcuggugcucguggucucccugggggccaucagcuucuggaugugcuccaacggcagccugcagugccggaucugcaucuga

SEQ ID NO: 6184 - RNA, 1698 nt, Artificial Sequence; identical to SEQ ID NO: 5758
  derived and/or modified CDS sequence (AUadapt) from InfluenzaA__ADN06300__HA

SEQ ID NO: 6185 - RNA, 1698 nt, Artificial Sequence
  derived and/or modified CDS sequence (AUadapt) from InfluenzaA__ADN06311__HA
augaaggugaagcugcucguccugcugugcacccucaccgccacguacgccgacaccaucugcaucggcuaccacgcgaacaacucgaccgacaccguggacacggugcuggagaagaacgucaccgugacccacuccgugaaccugcucgagaacagccacaacgggaagcugugccugcucaagggcaucgcgccccugcagcuggggaacugcuccgucgccggcuggauccucgggaacccggagugcgagcugcugaucucgaaggaguccuggagcuacaucguggagaagcccaaccccgagaacgggaccugcuaccccggccacuucgccgacuacgaggagcuccgcgagcagcuguccagcguguccucguucgagcgguucgagaucuucccgaagggcuccagcuggcccaaccacacggucaccggcguguccgccagcugcucccacaacggggagaacucguucuaccgcaaccugcucuggcugaccggcaagaacgggcuguaccccaaccucuccaagagcuacgccaacaacaaggagaaggaggugcugguccuguggggcgugcaccacccgcccaacaucgccgaccagaagacccucuaccacacggagaacgccuacguguccgucgugagcucgcacuacucccggaaguucacccccgagaucgccaagcgccccaaggugcgggaccaggagggccgcaucaacuacuacuggacccugcuggagcccggggacaccaucaucuucgaggcgaacggcaaccucaucgccccgcgguacgccuucgcccugagccgcggguucggcuccggcaucaucaacucgaacgcccccauggacaagugcgacgcgaagugccagacgccccagggggccaucaacuccagccugcccuuccagaacguccacccggugaccaucggcgagugccccaaguacgugcgguccgccaagcuccgcauggucaccgggcugcggaacauccccagcauccagucccgcggccuguucggggccaucgccggcuucaucgagggcggguggaccggcaugguggacgggugguacggcuaccaccaccagaacgagcaggggucgggcuacgcggccgaccagaaguccacgcagaacgccaucaacggcaucaccaacaaggugaacagcgucaucgagaagaugaacacccaguucaccgccguggggaaggaguucaacaagcucgagcggcgcauggagaaccugaacaagaaggucgacgacggcuucaucgacaucuggacguacaacgccgagcugcucgugcugcuggagaacgagcggacccucgacuuccacgacuccaacgugaagaaccuguacgagaaggucaagagccagcugaagaacaacgcgaaggagaucgggaacggcugcuucgaguucuaccacaagugcaacgacgagugcauggaguccgugaagaacgggaccuacgacuaccccaaguacucggaggaguccaagcucaaccgcgagaagaucgacggcgugaagcuggagagcaugggcgucuaccagauccuggccaucuacuccaccguggccagcucgcucgugcugcuggucucccucggggccaucagcuucuggaugugcuccaacggcagccugcagugccggaucugcaucuga

SEQ ID NO: 6186 - RNA, 1698 nt, Artificial Sequence
  derived and/or modified CDS sequence (AUadapt) from InfluenzaA__ADN06322__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccucgguguccagcuucgagcgguucgagaucuucccgaaggaguccagcuggcccaaccacacggucaccgggguguccgccagcugcucccacaacggcgagucguccuucuaccgcaaccugcuguggcucaccgggaagaacggccuguaccccaaccugagcaaguccuacgccaacaacaaggagaaggaggugcucguccuguggggcgugcaccacccgcccaacaugguggaccagcggacccuguaccgcacggagaacgccuacgucagcguggugagcucccacuacucgcggaaguucacccccgagaucgccaagcgccccaagguccgggaccaggagggccgcaucaacuacuacuggacccuccuggagcccggcgacaccaucaucuucgaggccaacgggaaccugaucgcgccgcgguacgccuucgcccucucccgcggcuucgggagcggcaucaucaacuccaacgcccccaugggcaagugcgacgccaagugccagacgccccagggggcgaucaacagcucccugcccuuccagaacgugcacccggugaccaucggcgagugccccaaguacguccggagcgccaagcugcgcauggugaccgggcuccggaacauccccuccauccagucgcgcggccuguucggggccaucgccggcuucaucgagggcggguggaccggcaugguggacgggugguacggcuaccaccaccagaacgagcagggguccggcuacgccgcggaccagaaguccacgcagaacgccaucaacggcaucaccaacaaggucaacagcgugaucgagaagaugaacacccaguucaccgccgucgggaaggaguucaacaagcuggagcggcgcauggagaaccucaacaagaagguggacgacggcuucaucgacaucuggacguacaacgccgagcugcuggugcuccuggagaacgagcggacccuggacuuccacgacagcaacgucaagaaccucuacgagaaggugaagucccagcugaagaacaacgccaaggagaucgggaacggcugcuucgaguucuaccacaagugcaacgacgagugcauggagagcgugaagaacgggaccuacgacuaccccaaguacuccgaggagucgaagcugaaccgcgagaagaucgacggcgucaagcucgaguccaugggcguguaccagauccuggcgaucuacagcaccguggccagcucccugguccuccuggugagccugggggccaucuccuucuggaugugcagcaacggcucccuccagugccggaucugcaucuga

SEQ ID NO: 6187 - RNA, 1698 nt, Artificial Sequence
  derived and/or modified CDS sequence (AUadapt) from InfluenzaA__ADN06344__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccucgguguccagcuucgagcgguucgagaucuucccgaaggaguccagcuggcccaaccacacggucaccgggguguccgccagcugcucccacaacggcgagucguccuucuaccgcaaccugcuguggcucaccgggaagaacggccuguaccccaaccugagcaaguccuacgccaacaacaaggagaaggaggugcucguccuguggggcgugcaccacccgcccagcaucagcgaccagaagacccuguaccacacggagaacgccuacguguccgucgugagcucccacuacucgcggaaguucacccccgagaucgccaagcgccccaaggugcgggaccaggagggccgcaucaacuacuacuggacccuccuggagcccggcgacaccaucaucuucgaggccaacgggaaccugaucgcgccgcgguacgccuucgcccucucccgcggcuucgggagcggcaucaucaacuccaacgcccccauggacaagugcgacgccaagugccagacgccccagggcgcgaucaacagcucccugcccuuccagaacguccacccggugaccaucggggagugccccaaguacgugcggagcgccaagcugcgcauggucaccggccuccggaacauccccuccauccagucgcgcgggcuguucggcgccaucgccggguucaucgagggcggcuggaccgggaugguggacggcugguacggguaccaccaccagaacgagcagggcuccggguacgccgcggaccagaaguccacgcagaacgccaucaacggcaucaccaacaaggugaacagcgucaucgagaagaugaacacccaguucaccgccgugggcaaggaguucaacaagcuggagcggcgcauggagaaccucaacaagaaggucgacgacggguucaucgacaucuggacguacaacgccgagcugcuggugcuccuggagaacgagcggacccuggacuuccacgacagcaacgugaagaaccucuacgagaaggucaagucccagcugaagaacaacgccaaggagaucggcaacgggugcuucgaguucuaccacaagugcaacgacgagugcauggagagcgugaagaacggcaccuacgacuaccccaaguacuccgaggagucgaagcugaaccgcgagaagaucgacggggugaagcucgagagcaugggcgucuaccagauccuggcgaucuacuccaccguggccagcucccuggugcuccuggucagccugggcgccaucuccuucuggaugugcagcaacgggucccuccagugccggaucugcaucuga

SEQ ID NO: 6188 - RNA, 1701 nt, Artificial Sequence; identical to SEQ ID NO: 5778
  derived and/or modified CDS sequence (AUadapt) from InfluenzaA__ADN06366__HA

SEQ ID NO: 6189 - RNA, 1701 nt, Artificial Sequence
  derived and/or modified CDS sequence (AUadapt) from InfluenzaA__ADN26165__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggggaagcacaacggcaagcucugcaagcugcgcggggucgcgccccugcaccucggcaagugcaacaucgccggguggauccugggcaacccggagugcgagucgcuguccaccgccagcuccuggucguacaucguggagaccuccagcuccgacaacggcacgugcuaccccggggacuucaucgacuacgaggagcuccgggagcagcugucguccgugagcuccuucgagcgcuucgagaucuuccccaagaccucguccuggcccaaccacgacagcaacaagggcgucaccgccgccugcccgcacgccggggcgaaguccuucuacaagaaccugaucuggcucaucaagaagggcaacucguaccccaagcuguccaagagcuacaucaacgacaaggggaaggaggugcuggugcucuggggcauccaccaccccucgaccuccgccgaccagcagagccuguaccagaacgccgacgccuacgucuucgugggcacgucccgguacucgaagaaguucaagcccgagaucgccauccgcccgaaggugcgggaccaggaggggcgcaugaacuacuacuggacccuggucgagcccggcgacaagaucaccuucgaggcgaccgggaaccucguggugccccgguacgccuucgccauggagcgcaacgccggcuccggcaucaucaucagcgacacgcccguccacgacugcaacacgaccugccagaccccgaagggggccaucaacaccucccugcccuuccagaacauccaccccaucaccaucggcaagugccccaaguacgucaagucgaccaagcugcggcucgcgaccgggcugcgcaacaucccguccauccagagccggggccuguucggggccaucgccggcuucaucgagggcggguggacgggcaugguggacgggugguacggcuaccaccaccagaacgagcagggguccggcuacgccgccgaccucaagucgacccagaacgcgaucgacgagaucaccaacaaggugaacuccgugaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggucaagcucgagagcgcgcgcaucuaccagauccuggccaucuacuccaccguggccucgagccuggugcucgucgugucccugggcgccaucucguucuggaugugcuccaacggcagccugcagugccggaucugcaucuga

SEQ ID NO: 6190 - RNA, 1701 nt, Artificial Sequence; identical to SEQ ID NO: 96
  derived and/or modified CDS sequence (AUadapt) from InfluenzaA__ADN26175__HA

SEQ ID NO: 6191 - RNA, 1701 nt, Artificial Sequence
  derived and/or modified CDS sequence (AUadapt) from InfluenzaA__ADN78194__HA
augaaggccauccuggugguccuccuguacaccuucgccaccacgaacgcggacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagacguccagcuccgacaacgggaccugcuaccccggcgacuucaucgacuacgaggagcuccgggagcagcugucguccgugagcuccuucgagcgcuucgagaucuuccccaagaccucguccuggcccaaccacgacucgaacaagggcgucaccgccgccugcccgcacgccggcgccaaguccuucuacaagaaccugaucuggcucgugaagaaggggaacagcuaccccaagcuguccaagucguacaucaacgacaagggcaaggaggugcugguccucugggggauccaccaccccagcacguccgcggaccagcagucgcuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucucggacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagucgcgggggcuguucggcgcgaucgccggguucaucgagggcggcuggaccgggaugguggacggcugguacggguaccaccaccagaacgagcagggcuccggguacgccgccgaccucaagucgacccagaacgccaucgacaagaucaccaacaaggugaacuccgucaucgagaagaugaacacgcaguucaccgcggugggcaaggaguucaaccaccuggagaagcgcaucgagaaccugaacaagaaggucgacgacggccuccuggacaucuggaccuacaacgccgagcugcucgugcugcuggagaacgagcggacccucgacuaccacgacagcaacgugaagaaccuguacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcucaaccgggaggagaucgacggcgugaagcuggagagcacccgcaucuaccagauccuggccaucuacuccaccgucgcgucgagccucgugcugguggucucccugggggccaucucguucuggaugugcuccaacggcagccuccagugccggaucugcaucuga

SEQ ID NO: 6192 - RNA, 1701 nt, Artificial Sequence; identical to SEQ ID NO: 4078
  derived and/or modified CDS sequence (AUadapt) from InfluenzaA__ADN78195__HA

SEQ ID NO: 6193 - RNA, 1701 nt, Artificial Sequence; identical to SEQ ID NO: 4466
  derived and/or modified CDS sequence (AUadapt) from InfluenzaA__ADN78212__HA

SEQ ID NO: 6194 - RNA, 1701 nt, Artificial Sequence; identical to SEQ ID NO: 4466
  derived and/or modified CDS sequence (AUadapt) from InfluenzaA__ADN78221__HA

SEQ ID NO: 6195 - RNA, 1698 nt, Artificial Sequence; identical to SEQ ID NO: 6185
  derived and/or modified CDS sequence (AUadapt) from InfluenzaA__ADN89050__HA

SEQ ID NO: 6196 - RNA, 1698 nt, Artificial Sequence
  derived and/or modified CDS sequence (AUadapt) from InfluenzaA__ADN89061__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccucgugcucccacaacggcgagagcuccuucuaccgcaaccugcuguggcucaccgagaagaacgggcuguaccccaaccugagcaaguccuacgccaacaacaaggagaaggaggugcucguccuguggggcgugcaccacccgcccagcaucucggaccagaagacccuguaccacacggagaacgccuacguguccgucgugagcucccacuacagccggaaguucacccccgagaucgccaagcgccccaaggugcgggaccaggaggggcgcaucaacuacuacuggacccuccuggagcccggcgacaccaucaucuucgaggccaacggcaaccugaucgcgccgcgguacgccuucgcccucucccgcggguucggcucggggaucaucaacuccaacgcccccauggacaagugcgacgccaagugccagacgccccagggcgcgaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggcuggaccggcaugguggacgggugguacggcuaccaccaccagaacgagcagggguccggcuacgccgcggaccagaaguccacgcagaacgccaucaacgagaucaccaacaaggugaacucggucaucgagaagaugaacacccaguucaccgccguggggaaggaguucaacaagcuggagcggcgcauggagaaccucaacaagaaggucgacgacggcuucaucgacaucuggacguacaacgccgagcugcuggugcuccuggagaacgagcggacccuggacuuccacgacagcaacgugaagaaccucuacgagaaggucaagaaccagcugaagaacaacgccaaggagaucggcaacgggugcuucgaguucuaccacaagugcaacgacgagugcauggaguccgugaagaacggcaccuacgacuaccccaaguacagcgaggaguccaagcugaaccgcgagaagaucgacggggugaagcucgagagcaugggcgucuaccagauccuggcgaucuacucgaccguggccuccagccuggugcuccuggucucccugggggccaucagcuucuggaugugcuccaacggcagccuccagugccggaucugcaucuga

SEQ ID NO: 6197 - RNA, 1698 nt, Artificial Sequence; identical to SEQ ID NO: 6187
  derived and/or modified CDS sequence (AUadapt) from InfluenzaA__ADN89072__HA

SEQ ID NO: 6198 - RNA, 1698 nt, Artificial Sequence
  derived and/or modified CDS sequence (AUadapt) from InfluenzaA__ADN89083__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccucguggcccaaccacacggucaccgggguguccgccagcugcucccacaacggcgagaacagcuucuaccgcaaccugcuguggcucaccgggaagaacggccuguaccccaaccuguccaagucguacgccaacaacaaggagaaggaggugcucguccuguggggcgugcaccacccgcccaacauggccgaccagaagacccuguaccacacggagaacgccuacguguccgucgugagcagccacuacucccggaaguucacccccgagaucgccaagcgccccaaggugcgggaccaggagggccgcaucaacuacuacuggacccuccuggagcccggcgacaccaucaucuucgaggcgaacgggaaccugaucgccccgcgguacgccuucgcccucucgcgcggcuucggguccggcaucaucaacagcaacgcccccauggacaagugcgacgcgaagugccagacgccccagggcgccaucaacuccagccugcccuuccagaacguccacccggugaccaucggggagugccccaaguacgugcgguccgccaagcugcgcauggucaccggccuccggaacauccccucgauccagucccgcgggcuguucggcgccaucgccggguucaucgagggcggcuggaccgggaugguggacggcugguacggguaccaccaccagaacgagcagggcagcggguacgcggccgaccagaaguccacgcagaacgccaucaacggcaucaccaacaaggugaacagcgucaucgagaagaugaacacccaguucaccgccgugggcaaggaguucaacaagcuggagcggcgcauggagaaccucaacaagaaggucgacgacggguucaucgacaucuggacguacaacgccgagcugcuggugcuccuggagaacgagcggacccuggacuuccacgacuccaacgugaagaaccucuacgagaaggucaagucgcagcugaagaacaacgcgaaggagaucggcaacgggugcuucgaguucuaccacaagugcaacgacgagugcauggaguccgugaagaacggcaccuacgacuaccccaaguacagcgaggaguccaagcugaaccgcgagaagaucgacggggugaagcucgagagcaugggcgucuaccagauccuggccaucuacuccaccguggccucgagccuggugcuccuggucucccugggcgccaucagcuucuggaugugcuccaacgggagccuccagugccggaucugcaucuga

SEQ ID NO: 6199 - RNA, 1698 nt, Artificial Sequence
  derived and/or modified CDS sequence (AUadapt) from InfluenzaA__ADN89094__HA
augaaggugaagcugcucguccugcugugcaccuucaccgccacguacgccgacaccaucugcaucggcuaccacgcgaacaacucgaccgacaccguggacacggcccucgagaagaacgugaccgucacccacuccgugaaccugcuggagaacagccacaacgggaagcucugccugcugaagggcaucgcgccccuccagcuggggaacugcuccguggccggcuggauccuggggaacccggagugcgagcuccugaucucgaaggaguccuggagcuacaucgucgagaagcccaaccccgagaacgggaccugcuaccccggccacuucgccgacuacgaggagcugcgcgagcagcucuccagcguguccucguucgagcgguucgagaucuucccgaaggaguccagcuggcccaaccacacggugaccggcgucuccgccagcugcucccacaacggcgagaacucguucuaccgcaaccugcuguggcucaccgggaagaacggccuguaccccaaccuguccaagagcuacgccaacaacaaggggaaggaggugcucgugcuguggggcguccaccacccgcccaacaucgccgaccagaagacccuguaccacacggagaacgccuacguguccguggucagcucgcacuacucccggaaguucacccccgagaucgcgaagcgccccaaggugcgggaccaggagggccgcaucaacuacuacuggacccuccuggagcccggggacaccaucaucuucgaggccaacggcaaccugaucgccccgcgguacgccuucgcccucagccgcggguucggcuccggcaucaucaacucgaacgcgcccauggacaagugcgacgccaagugccagacgccccagggggccaucaacuccagccugcccuuccagaacgugcacccggucaccaucggcgagugccccaaguacgugcgguccgccaagcugcgcauggugaccgggcuccggaacauccccagcauccagucccgcggccuguucggggccaucgcgggcuucaucgagggcggguggaccggcauggucgacgggugguacggcuaccaccaccagaacgagcaggggucgggcuacgccgccgaccagaaguccacgcagaacgccaucaacggcaucaccaacaaggugaacagcgugaucgagaagaugaacacccaguucaccgccgucgggaaggaguucaacaagcuggagcggcgcauggagaaccucaacaagaagguggacgacggcuucaucgacaucuggacguacaacgcggagcugcugguccuccuggagaacgagcggacccuggacuuccacgacuccaacgugaagaaccucuacgagaaggucaagagccagcugaagaacaacgccaaggagaucgggaacggcugcuucgaguucuaccacaagugcaacgacgagugcauggaguccgugaagaacgggaccuacgacuaccccaaguacucggaggaguccaagcugaaccgcgagaagaucgacggcgugaagcucgagagcaugggcguguaccagauccuggccaucuacuccaccgucgccagcucgcuggugcuccuggugucccugggggccaucagcuucuggaugugcuccaacggcagccuccagugccggaucugcaucuga

SEQ ID NO: 6200 - RNA, 1698 nt, Artificial Sequence
  derived and/or modified CDS sequence (AUadapt) from InfluenzaA__ADN89116__HA
augaaggugaagcugcucauccugcugugcaccuucaccgccacguacgccgacaccaucugcaucggcuaccacgcgaacaacucgaccgacaccgucgacacggugcucgagaagaacgugaccgucacccacuccgugaaccugcuggagaacagccacaacgggaagcucugccugcugaagggcaucgcgccccuccagcuggggaacugcuccguggccggcuggauccuggggaacccggagugcgagcuccugaucagcaaggaguccuggagcuacaucgucgagaagcccaaccccgagaacgggaccugcuaccccggccacuucgccgacuacgaggagcugcgcgagcagcucuccagcguguccucguucgagcgguucgagaucuucccgaaggaguccagcuggcccaaccacacggugaccggggucuccgccagcugcucccacaacggcgagagcuccuucuaccgcaaccugcuguggcucaccgugaagaacgggcuguaccccaaccugagcaaguccuacgccaacaacaaggagaaggaggugcucguccuguggggcgugcaccacccgcccaacaucguggaccagaagacccuguaccggacggagaacgccuacgucucgguggugagcucccacuacagccgcaaguucacccccgagaucgccaagcggcccaagguccgcgaccaggaggggcggaucaacuacuacuggacccuccuggagcccggcgacaccaucaucuucgaggccaacggcaaccugaucgcgccgcgcuacgccuucgcccucucccggggguucggcagcgggaucaucaacuccaacgcccccauggacaagugcgacgccaagugccagacgccccgcggcgcgaucaacagcucccugcccuuccagaacgugcacccggugaccaucggcgagugccccaaguacguccggucggccaagcugcgcauggugaccgggcuccggaacauccccuccauccagagccgcggccuguucggggccaucgccggcuucaucgagggcggcuggaccggcaugguggacgggugguacggcuaccaccaccagaacgagcagggguccggcuacgccgcggaccagaaguccacgcagaacgccaucaacgggaucaccaacaaggucaacagcgugaucgagaagaugaacacccaguucaccgccgucggcaaggaguucaacaaccuggagcggcgcauggagaaccucaacaagaagguggacgacggcuucaucgacaucuggacguacaacgccgagcugcuggugcuccuggagaacgagcggacccuggacuuccacgacagcaacgucaagaaccucuacgagaaggugaagucccagcugaagaacaacgccaaggagaucgggaacggcugcuucgaguucuaccacaagugcaacgacgagugcauggagagcgugaagaacgggaccuacgacuaccccaaguacuccgaggagucgaagcugaaccgcgagaagaucgacggcgucaagcucgaguccauggggguguaccagauccuggcgaucuacagcaccguggccagcucccugguccuccuggugagccugggcgccaucuccuucuggaugugcagcaacggcucccuccagugccggaucugcaucuga

SEQ ID NO: 6201 - RNA, 1698 nt, Artificial Sequence
  derived and/or modified CDS sequence (AUadapt) from InfluenzaA__ADN89127__HA
augaaggugaagcugcucguccugcugugcacccucaccgccacguacgccgacaccaucugcaucggcuaccacgcgaacaacucgaccgacaccguggacacggugcuggagaagaacgucaccgugacccacuccgugaaccugcucgagaacagccacaacgggaagcugugccugcucaagggcaucgcgccccugcagcuggggaacugcuccgucgccggcuggauccucgggaacccggagugcgagcugcugaucucgaaggaguccuggagcuacaucguggagaagcccaaccccgagaacgggaccugcuaccccggccacuucgccgacuacgaggagcuccgcgagcagcuguccagcguguccucguucgagcgguucgagaucuucccgaagggcuccagcuggcccaaccacacggucaccggcguguccgccagcugcucccacaacggggagaacucguucuaccgcaaccugcucuggcugaccggcaagaacgggcuguaccccaaccucuccaagagcuacgccaacaacaaggagaaggaggugcugguccuguggggcgugcaccacccgcccaacaucgccgaccagaagacccucuaccacacggagaacgccuacguguccgucgugagcucgcacuacucccggaaguucacccccgagaucgccaagcgccccaaggugcgggaccaggagggccgcaucaacuacuacuggacccugcuggagcccggggacaccaucaucuucgaggcgaacggcaaccucaucgccccgcgguacgccuucgcccugagccgcggguucggcuccggcaucaucaacucgaacgcccccauggacaagugcgacgcgaagugccagacgccccagggggccaucaacuccagccugcccuuccagaacguccacccggugaccaucggcgagugccccaaguacgugcgguccgccaagcuccgcauggucaccgggcugcggaacauccccagcauccagucccgcggccuguucggggccaucgccggcuucaucgagggcggguggaccggcaugguggacgggugguacggcuaccaccaccagaacgagcaggggucgggcuacgcggccgaccagaaguccacgcagaacgccaucaacggcaucaccaacaaggugaacagcgucaucgagaagaugaacacccaguucaccgccguggggaaggaguucaacaagcucgagcggcgcauggagaaccugaacaagaaggucgacgacggcuucaucgacaucuggacguacaacgccgagcugcucgugcugcuggagaacgagcggacccucgacuuccacgacuccaacgugaagaaccuguacgagaaggucaagagccagcugaagaacaacgcggaggagaucgggaacggcugcuucgaguucuaccacaagugcaacgacgagugcauggaguccgugaagaacgggaccuacgacuaccccaaguacucggaggaguccaagcucaaccgcgagaagaucgacggcgugaagcuggagagcaugggcgucuaccagauccuggccaucuacuccaccguggccagcucgcucgugcugcuggucucccucggggccaucagcuucuggaugugcuccaacggcagccugcagugccggaucugcaucuga

SEQ ID NO: 6202 - RNA, 1698 nt, Artificial Sequence
  derived and/or modified CDS sequence (AUadapt) from InfluenzaA__ADN89149__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccucgguguccagcuucgagcgguucgagaucuucccgaaggaguccagcuggcccaaccacacggucaccgggguguccgccagcugcucccacaacggcgagucguccuucuaccgcaaccugcuguggcucaccgagaagaacgggcuguaccccaaccugagcaaguccuacgccaacaacaaggagaaggaggugcucguccuguggggcgugcaccacccgcccagcaucagcgaccagaagacccuguaccacacggagaacgccuacguguccgucgugagcucccacuacucgcggaaguucacccccgagguggccaagcgccccaagguccgggaccaggaggggcgcaucaacuacuacuggacccuccuggagcccggcgacaccaucaucuucgaggccaacggcaaccugaucgcgccgcgguacgccuucgcccucucccgcggguucggcagcgggaucaucaacuccaacgcccccauggacaagugcgacgccaagugccagacgccccagggcgcgaucaacagcucccugcccuuccagaacgugcacccggugaccaucggcgagugccccaaguacguccggagcgccaagcugcgcauggugaccgggcuccggaacauccccuccauccagucgcgcggccuguucggggccaucgccggcuucaucgagggcggcuggaccggcaugguggacgggugguacggcuaccaccaccagaacgagcagggguccggcuacgccgcggaccagaaguccacgcagaacgccaucaacgggaucaccaacaaggucaacagcgugaucgagaagaugaacacccaguucaccgccgucggcaaggaguucaacaagcuggagcggcgcauggagaaccucaacaagaagguggacgacggcuucaucgacaucuggacguacaacgccgagcugcuggugcuccuggagaacgagcggacccuggacuuccacgacagcaacgucaagaaccucuacgagaaggugaagucccagcugaagaacaacgccaaggagaucgggaacggcugcuucgaguucuaccacaagugcaacgacgagugcauggagagcgugaagaacgggaccuacgacuaccccaaguacuccgaggagucgaagcugaaccgcgagaagaucgacggcgucaagcucgagagcauggggguguaccagauccuggcgaucuacuccaccguggccagcucccugguccuccuggugagccugggcgccaucuccuucuggaugugcagcaacggcucccuccagugccggaucugcaucuga

SEQ ID NO: 6203 - RNA, 1698 nt, Artificial Sequence; identical to SEQ ID NO: 5758
  derived and/or modified CDS sequence (AUadapt) from InfluenzaA__ADN89171__HA

SEQ ID NO: 6204 - RNA, 1698 nt, Artificial Sequence
  derived and/or modified CDS sequence (AUadapt) from InfluenzaA__ADN89182__HA
augaaggugaagcugcucguccugcugugcacccucaccgccacguacgccgacaccaucugcaucggcuaccacgcgaacaacucgaccgacaccguggacacggugcuggagaagaacgucaccgugacccacuccgugaaccugcucgagaacagccacaacgggaagcugugccugcucaagggcaucgcgccccugcagcuggggaacugcuccgucgccggcuggauccucgggaacccggagugcgagcugcugaucagcaaggaguccuggucguacaucguggagaagcccaaccccgagaacgggaccugcuaccccggccacuucgccgacuacgaggagcuccgcgagcagcuguccagcguguccagcuucgagcgguucgagaucuucccgaaggaguccagcuggcccaaccacacggucaccgggguguccgccucgugcucccacaacggcgagagcuccuucuaccgcaaccugcucuggcugaccgggaagaacggccuguaccccaaccucagcaaguccuacgccaacaacaaggagaaggaggugcugguccuguggggcgugcaccacccgcccaacaucguggaccagaagacccucuaccggacggagaacgccuacgucucgguggugagcucccacuacagccgcaaguucacccccgagaucgccaagcggcccaagguccgcgaccaggagggccggaucaacuacuacuggacccugcuggagcccggcgacaccaucaucuucgaggccaacgggaaccucaucgcgccgcgcuacgccuucgcccugucccggggcuucgggagcggcaucaucaacuccaacgcccccauggacaagugcgacgccaagugccagacgccccagggcgcgaucaacucgucccugcccuuccagaacgugcacccggugaccaucggggagugccccaaguacguccgcagcgccaagcuccggauggugaccggccugcgcaacauccccuccauccagagccgggggcuguucggcgccaucgccggguucaucgagggcggcuggaccgggaugguggacggcugguacggguaccaccaccagaacgagcagggcuccggguacgccgcggaccagaaguccacgcagaacgccaucaacggcaucaccaacaaggucaacucggugaucgagaagaugaacacccaguucaccgccgucggcaaggaguucaacaagcucgagcgccggauggagaaccugaacaagaagguggacgacggguucaucgacaucuggacguacaacgccgagcugcucgugcugcuggagaacgagcgcacccucgacuuccacgacagcaacgucaagaaccuguacgagaaggugaagucccagcugaagaacaacgccaaggagaucggcaacgggugcuucgaguucuaccacaagugcaacgacgagugcauggagagcgugaagaacggcaccuacgacuaccccaaguacuccgaggagagcaagcucaaccgggagaagaucgacggggucaagcuggaguccaugggcguguaccagauccuggcgaucuacucgaccguggccagcucccucguccugcuggugagccucggcgccaucuccuucuggaugugcagcaacgggucccugcagugccgcaucugcaucuga

SEQ ID NO: 6205 - RNA, 1698 nt, Artificial Sequence; identical to SEQ ID NO: 5758
  derived and/or modified CDS sequence (AUadapt) from InfluenzaA__ADN89193__HA

SEQ ID NO: 6206 - RNA, 1698 nt, Artificial Sequence; identical to SEQ ID NO: 5758
  derived and/or modified CDS sequence (AUadapt) from InfluenzaA__ADN89204__HA

SEQ ID NO: 6207 - RNA, 1698 nt, Artificial Sequence; identical to SEQ ID NO: 6185
  derived and/or modified CDS sequence (AUadapt) from InfluenzaA__ADN89215__HA

SEQ ID NO: 6208 - RNA, 1698 nt, Artificial Sequence
  derived and/or modified CDS sequence (AUadapt) from InfluenzaA__ADN89226__HA
augaaggugaagcugcucguccugcugugcaccuucgccgccaccuacgcggacacgaucugcaucggcuaccacgccaacaacucgaccgacaccguggacaccgugcucgagaagaacgucacggugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacaccgucacggggguguccgccucgugcucccacaacggcgagagcuccuucuaccgcaaccugcuguggcucaccgagaagaacgggcuguaccccaaccugagcaaguccuacgccaacaacaaggagaaggaggugcucguccuguggggcgugcaccacccgcccucgaucagcgaccagaagacccuguaccacaccgagaacgccuacguguccgucgugagcucccacuacagccggaaguucacgcccgagaucgccaagcgccccaaggugcgggaccaggaggggcgcaucaacuacuacuggacccuccuggagcccggcgacaccaucaucuucgaggcgaacggcaaccugaucgccccgcgguacgccuucgcccucaaccgcggguucggcuccgggaucaucaacucgaacgcccccauggacaagugcgacgcgaagugccagacgccccagggcgccaucaacuccagccugcccuuccagaacguccacccggugaccaucggcgagugccccaaguacgugcgguccgccaagcugcgcauggucaccgggcuccggaacauccccagcgugcagucccgcggccuguucggggccaucgccggcuucaucgagggcggcuggaccggcaugguggacgggugguacggcuaccaccaccagaacgagcaggggucgggcuacgcggccgaccagaaguccacccagaacgccaucaacgggaucacgaacaaggucaacagcgugaucgagaagaugaacacccaguucaccgccgucggcaaggaguucaacaagcuggagcggcgcauggagaaccucaacaagaagguggacgacggcuucaucgacaucuggaccuacaacgccgagcugcuggugcuccuggagaacgagcggacgcuggacuuccacgacuccaacgucaagaaccucuacgagaaggugaagaaccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgucaagcucgaguccauggggguguaccagauccuggccaucuacucgaccguggccagcucccugguccuccuggugagccugggcgccaucuccuucuggaugugcagcaacggcucccuccagugccggaucugcaucuga

SEQ ID NO: 6209 - RNA, 1698 nt, Artificial Sequence; identical to SEQ ID NO: 6185
  derived and/or modified CDS sequence (AUadapt) from InfluenzaA__ADN89237__HA

SEQ ID NO: 6210 - RNA, 1698 nt, Artificial Sequence
  derived and/or modified CDS sequence (AUadapt) from InfluenzaA__ADN89248__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccaucgccggcuggauccuggggaacccggagugcgagcuccugaucagcaaggaguccuggagcuacaucgucgagaagcccaaccccgagaacgggaccugcuaccccggccacuucgccgacuacgaggagcugcgcgagcagcucuccucgguguccagcuucgagcgguucgagaucuucccgaaggaguccagcuggcccaaccacacggugaccggggucuccgccagcugcucccacaacggcgagucguccuucuaccgcaaccugcuguggcucaccgggaagaacggccuguaccccaaccugagcaaguccuacgccaacaacaaggagaaggaggugcucgugcuguggggcguccaccacccgcccagcaucagcgaccagaagacccuguaccacacggagaacgccuacguguccguggucagcucccacuacucgcggaaguucacccccgagaucgccaagcgccccaaggugcgggaccaggagggccgcaucaacuacuacuggacccuccuggagcccggcgacaccaucaucuucgaggccaacgggaaccugaucgcgccgcgguacgccuucgcccucucccgcggcuucgggagcggcaucaucaacuccaacgcccccauggacaagugcgacgccaagugccagacgccccagggcgcgaucaacagcucccugcccuuccagaacgugcacccggucaccaucggggagugccccaaguacgugcggagcgccaagcugcgcauggugaccggccuccggaacauccccuccauccagucgcgcgggcuguucggcgccaucgccggguucaucgagggcggcuggaccgggauggucgacggcugguacggguaccaccaccagaacgagcagggcuccggguacgccgcggaccagaaguccacgcagaacgccaucaacggcaucaccaacaaggugaacagcgugaucgagaagaugaacacccaguucaccgccgucggcaaggaguucaacaagcuggagcggcgcauggagaaccucaacaagaagguggacgacggguucaucgacaucuggacguacaacgccgagcugcugguccuccuggagaacgagcggacccuggacuuccacgacagcaacgugaagaaccucuacgagaaggugaagucccagcugaagaacaacgccaaggagaucggcaacgggugcuucgaguucuaccacaagugcaacgacgagugcauggagagcgucaagaacggcaccuacgacuaccccaaguacuccgaggagucgaagcugaaccgcgagaagaucgacggggugaagcucgagagcaugggcguguaccagauccuggcgaucuacuccaccgucgccagcucccuggugcuccuggugagccugggcgccaucuccuucuggaugugcagcaacgggucccuccagugccggaucugcaucuga

SEQ ID NO: 6211 - RNA, 1698 nt, Artificial Sequence; identical to SEQ ID NO: 6198
  derived and/or modified CDS sequence (AUadapt) from InfluenzaA__ADN89259__HA

SEQ ID NO: 6212 - RNA, 1698 nt, Artificial Sequence
  derived and/or modified CDS sequence (AUadapt) from InfluenzaA__ADN89281__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccucgugcucccacaacggcgagagcuccuucuaccgcaaccugcuguggcucaccgagaagaacgggcuguaccccaaccugagcaaguccuacgccaacaacaaggagaaggaggugcucguccuguggggcgugcaccacccgcccagcaucucggaccagaagacccuguaccacacggagaacgccuacguguccgucgugagcucccacuacagccggaaguucacccccgagaucgccaagcgccccaaggugcgggaccaggaggggcgcaucaacuacuacuggacccuccuggagcccggcgacaccaucaucuucgaggccaacggcaaccugaucgcgccgcgguacgccuucgcccucucccgcggguucggcucggggaucaucaacuccaacgcccccauggacaagugcgacgccaagugccagacgccccagggcgcgaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggcuggaccggcaugguggacgggugguacggcuaccaccaccagaacgagcagggguccggcuacgccgcggaccagaaguccacgcagaacgccaucaacgggaucaccaacaaggugaacucggucaucgagaagaugaacacccaguucaccgccgugggcaaggaguucaacaagcuggagcggcgcauggagaaccucaacaagaaggucgacgacggcuucaucgacaucuggacguacaacgccgagcugcuggugcuccuggagaacgagcggacccuggacuuccacgacagcaacgugaagaaccucuacgagaaggucaagaaccagcugaagaacaacgccaaggagaucgggaacggcugcuucgaguucuaccacaagugcaacgacgagugcauggaguccgugaagaacgggaccuacgacuaccccaaguacagcgaggaguccaagcugaaccgcgagaagaucgacggcgugaagcucgagagcaugggggucuaccagauccuggcgaucuacucgaccguggccuccagccuggugcuccuggucucccugggcgccaucagcuucuggaugugcuccaacggcagccuccagugccggaucugcaucuga

SEQ ID NO: 6213 - RNA, 1698 nt, Artificial Sequence; identical to SEQ ID NO: 6212
  derived and/or modified CDS sequence (AUadapt) from InfluenzaA__ADN89292__HA

SEQ ID NO: 6214 - RNA, 1698 nt, Artificial Sequence; identical to SEQ ID NO: 6212
  derived and/or modified CDS sequence (AUadapt) from InfluenzaA__ADN89303__HA

SEQ ID NO: 6215 - RNA, 1698 nt, Artificial Sequence; identical to SEQ ID NO: 3871
  derived and/or modified CDS sequence (AUadapt) from InfluenzaA__ADN89314__HA

SEQ ID NO: 6216 - RNA, 1698 nt, Artificial Sequence; identical to SEQ ID NO: 3376
  derived and/or modified CDS sequence (AUadapt) from InfluenzaA__ADN89325__HA

SEQ ID NO: 6217 - RNA, 1698 nt, Artificial Sequence
  derived and/or modified CDS sequence (AUadapt) from InfluenzaA__ADN89336__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccucguggcccaaccacacggucaccgggguguccgccagcugcucccacaacggcgagcgcagcuucuaccggaaccugcuguggcucaccgggaagaacggccuguaccccaaccuguccaagucguacgccaacaacaaggagaaggaggugcucguccuguggggcgugcaccacccgcccgacaucggcgaccagaagacccuguaccacacggagaacgccuacguguccgucgugagcagccacuacucccgcaaguucacccccgagaucgccaagcggcccaaggugcgcgaccaggagggccggaucaacuacuacuggacccuccuggagcccggggacaccaucaucuucgaggccaacggcaaccugaucgcgccgcgcuacgccuucgcccucucgcggggguucggcuccggcaucaucaacagcaacgcccccauggacaagugcgacgccaagugccagacgccccagggggcgaucaacuccagccugcccuuccagaacguccacccggugaccaucggcgagugccccaaguacgugcgcuccgccaagcugcggauggucaccgggcuccgcaacauccccucgauccagucccggggccuguucggggccaucgccggcuucaucgagggcggguggaccggcaugguggacgggugguacggcuaccaccaccagaacgagcaggggagcggcuacgccgcggaccagaaguccacgcagaacgccaucaacggcaucaccaacaaggugaacagcgucaucgagaagaugaacacccaguucaccgccguggggaaggaguucaacaagcuggagcgccggauggagaaccucaacaagaaggucgacgacggcuucaucgacaucuggacguacaacgccgagcugcuggugcuccuggagaacgagcgcacccuggacuuccacgacuccaacgugaagaaccucuacgagaaggucaagucgcagcugaagaacaacgccaaggagaucgggaacggcugcuucgaguucuaccacaagugcaacgacgagugcauggaguccgugaagaacgggaccuacgacuaccccaaguacagcgaggaguccaagcugaaccgggagaagaucgacggcgugaagcucgagagcaugggcgucuaccagauccuggcgaucuacuccaccguggccucgagccuggugcuccuggucucccugggggccaucagcuucuggaugugcuccaacggcagccuccagugccgcaucugcaucuga

SEQ ID NO: 6218 - RNA, 1698 nt, Artificial Sequence; identical to SEQ ID NO: 6208
  derived and/or modified CDS sequence (AUadapt) from InfluenzaA__ADN89347__HA

SEQ ID NO: 6219 - RNA, 1698 nt, Artificial Sequence; identical to SEQ ID NO: 3376
  derived and/or modified CDS sequence (AUadapt) from InfluenzaA__ADN89358__HA

SEQ ID NO: 6220 - RNA, 1698 nt, Artificial Sequence
  derived and/or modified CDS sequence (AUadapt) from InfluenzaA__ADN89369__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccucguggcccaaccacacggucaccgggguguccgccagcugcucccacaacggcgagagcuccuucuaccgcaaccugcuguggcucaccgugaagaacgggcuguaccccaaccugagcaaguccuacgccaacaacaaggagaaggagguccucgugcuguggggcgugcaccacccgcccaacaucgucgaccagaagacccuguaccggacggagaacgccuacgugagcguggucagcucccacuacucgcgcaaguucauccccgagaucgccaagcggcccaaggugcgcgaccaggaggggcggaucaacuacuacuggacccuccuggagcccggcgacaccaucaucuucgaggccaacggcaaccugaucgcgccgcgcuacgccuucgcccucucccggggguucggcagcgggaucaucaacuccaacgcccccauggacaagugcgacgccaagugccagacgccccgcggcgcgaucaacagcucccugcccuuccagaacgugcacccggucaccaucggcgagugccccaaguacgugcggagcgccaagcugcgcauggugaccgggcuccggaacauccccuccauccagagccgcggccuguucggggccaucgccggcuucaucgagggcggcuggaccggcauggucgacgggugguacggcuaccaccaccagaacgagcagggguccggcuacgccgcggaccagaaguccacccagaacgccaucaacgggaucacgaacaaggugaacagcgucaucgagaagaugaacacccaguucaccgccgugggcaaggaguucaacaagcuggagcggcgcauggagaaccucaacaagaagguggacgacggcuucaucgacaucuggaccuacaacgccgagcugcugguccuccuggagaacgagcggacgcuggacuuccacgacucgaacgugaagaaccucuacgagaaggugaagucccagcugaagaacaacgccaaggagaucgggaacggcugcuucgaguucuaccacaagugcaacgacgagugcauggagagcgucaagaacgggaccuacgacuaccccaaguacuccgaggagagcaagcugaaccgcgagaagaucgacggcgugaagcucgaguccauggggguguaccagauccuggcgaucuacagcaccgucgccagcucccuggugcuccuggugagccugggcgccaucuccuucuggaugugcagcaacggcucccuccagugccggaucugcaucuga

SEQ ID NO: 6221 - RNA, 1698 nt, Artificial Sequence
  derived and/or modified CDS sequence (AUadapt) from InfluenzaA__ADN89380__HA
augaaggugaagcugcucguccugcugugcacccucaccgccacguacgccgacaccaucugcaucggcuaccacgcgaacaacucgaccgacaccguggacacggugcuggagaagaacgucaccgugacccacuccgugaaccugcucgagaacagccacaacgggaagcugugccugcucaagggcaucgcgccccugcagcuggggaacugcuccgucgccggcuggauccucgggaacccggagugcgagcugcugaucagcaaggaguccuggucguacaucguggagaagcccaaccccgagaacgggaccugcuaccccggccacuucgccgacuacgaggagcuccgcgagcagcuguccagcguguccagcuucgagcgguucgagaucuucccgaaggaguccagcuggcccaaccacacggucaccgggguguccgccucgugcucccacaacggcgagagcuccuucuaccgcaaccugcucuggcugaccgggaagaacggccuguaccccaaccucagcaaguccuacgccaacaacaaggagaaggaggugcugguccuguggggcgugcaccacccgcccaacaucguggaccagaagacccucuaccggacggagaacgccuacgucucgguggugagcucccacuacagccgcaaguucacccccgagaucgccaagcggcccaagguccgcgaccaggagggccggaucaacuacuacuggacccugcuggagcccggcgacaccaucaucuucgaggccaacgggaaccucaucgcgccgcgcuacgccuucgcccugucccggggcuucgggagcggcaucaucaacuccaacgcccccauggacaagugcgacgccaagugccagacgccccagggcgcgaucaacucgucccugcccuuccagaacgugcacccggugaccaucggggagugccccaaguacguccgcagcgccaagcuccggauggugaccggccugcgcaacauccccuccauccagagccgggggcuguucggcgccaucgccggguucaucgagggcggcuggaccgggaugguggacggcugguacggguaccaccaccagaacgagcagggcuccggguacgccgcggaccagaaguccacgcagaacgccaucaacggcaucaccaacaaggucaacucggugaucgagaagaugaacacccaguucaccgccgucggcaaggaguucaacaagcucgagcgccggauggagaaccugaacaagaagguggacgacggguucaucgacaucuggacguacaacgccgagcugcucgugcugcuggagaacgagcgcacccucgacuuccacgacagcaacgucaagaaccuguacgagaaggugaagucccagcugaagaacaacgccaaggagaucggcaacgggugcuucgaguucuaccacaagugcaacaacgagugcauggagagcgugaagaacggcaccuacgacuaccccaaguacuccgaggagagcaagcucaaccgggagaagaucgacggggucaagcuggaguccaugggcguguaccagauccuggcgaucuacucgaccguggccagcucccucguccugcuggugagccucggcgccaucuccuucuggaugugcagcaacgggucccugcagugccgcaucugcaucuga

SEQ ID NO: 6222 - RNA, 1698 nt, Artificial Sequence
  derived and/or modified CDS sequence (AUadapt) from InfluenzaA__ADN89391__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccucguggcccaaccacacggucaccgggguguccgccagcugcucccacaacggcgagcgcagcuucuacaagaaccugcuguggcucaccgggaagaacggccuguaccccaaccuguccaagucguacgccaacaacaaggagaaggaggugcucguccuguggggcgugcaccacccgcccgacaucggcgaccagaagacccuguaccacacggagaacgccuacguguccgucgugagcagccacuacucccggaaguucacccccgagaucgccaagcgccccaaggugcgggaccaggagggccgcaucaacuacuacuggacccuccuggagcccggggacaccaucaucuucgaggccaacggcaaccugaucgcgccgcgguacgccuucgcccucucgcgcggguucggcuccggcaucaucaacagcaacgcccccauggacaagugcgacgccaagugccagacgccccagggggcgaucaacuccagccugcccuuccagaacguccacccggugaccaucggcgagugccccaaguacgugcgguccgccaagcugcgcauggucaccgggcuccggaacauccccucgauccagucccgcggccuguucggggccaucgccggcuucaucgagggcggguggaccggcaugguggacgggugguacggcuaccaccaccagaacgagcaggggagcggcuacgccgcggaccagaaguccacgcagaacgccaucaacggcaucaccaacaaggugaacagcgucaucgagaagaugaacacccaguucaccgccguggggaaggaguucaacaagcuggagcggcgcauggagaaccucaacaagaaggucgacgacggcuucaucgacaucuggacguacaacgccgagcugcuggugcuccuggagaacgagcggacccuggacuuccacgacuccaacgugaagaaccucuacgagaaggucaagucgcagcugaagaacaacgccaaggagaucgggaacggcugcuucgaguucuaccacaagugcaacgacgagugcauggaguccgugaagaacgggaccuacgacuaccccaaguacagcgaggaguccaagcugaaccgcgagaagaucgacggcgugaagcucgagagcaugggcgucuaccagauccuggcgaucuacuccaccguggccucgagccuggugcuccuggucucccugggggccaucagcuucuggaugugcuccaacggcagccuccagugccggaucugcaucuga

SEQ ID NO: 6223 - RNA, 1698 nt, Artificial Sequence
  derived and/or modified CDS sequence (AUadapt) from InfluenzaA__ADN89402__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaagaaguccuggagcuacaucguggagaagcccaaccccgagaacgggaccugcuaccccggccacuucgccgacuacgaggagcugaaggagcagcucuccucgguguccagcuucgagcgcuucgagaucuucccgaaggaguccagcuggcccaaccacacggucaccgggguguccgccagcugcucccacaacggcgagucguccuucuaccggaaccugcuguggcucaccgggaagaacggccuguaccccaaccugagcaaguccuacgccaacaacaaggagaaggaggugcucguccuguggggcgugcaccacccgcccaacaucguggaccagaagacccuguaccgcacggagaacgccuacgucagcguggugagcucccacuacucgcggaaguucacccccgagaucgccaagcgccccaagguccgggaccaggagggccgcaucaacuacuacuggacccuccuggagcccggcgacaccaucaucuucgaggccaacgggaaccugaucgcgccgcgguacgccuucgcccucucccgcggcuucgggagcggcaucaucaacuccaacgcccccaugggcaagugcgacgccaagugccagacgccccagggggcgaucaacagcucccugcccuuccagaacgugcacccggugaccaucggcgagugccccaaguacguccggagcgccaagcugcgcauggugaccgggcuccggaacauccccuccauccagucgcgcggccuguucggggccaucgccggcuucaucgagggcggguggaccggcaugguggacgggugguacggcuaccaccaccagaacgagcagggguccggcuacgccgcggaccagaaguccacgcagaacgccaucaacggcaucaccaacaaggucaacagcgugaucgagaagaugaacacccaguucaccgccgucgggaaggaguucaacaagcuggagcggcgcauggagaaccucaacaagaagguggacgacggcuucaucgacaucuggacguacaacgccgagcugcuggugcuccuggagaacgagcggacccuggacuuccacgacagcaacgucaagaaccucuacgagaaggugaagucccagcugaagaacaacgccaaggagaucgggaacggcugcuucgaguucuaccacaagugcaacgacgagugcauggagagcgugaagaacgggaccuacgacuaccccaaguacuccgaggagucgaagcugaaccgcgagaagaucgacggcgucaagcucgaguccaugggcguguaccagauccuggcgaucuacagcaccguggccagcucccugguccuccuggugagccugggggccaucuccuucuggaugugcagcaacggcucccuccagugccggaucugcaucuga

SEQ ID NO: 6224 - RNA, 1698 nt, Artificial Sequence; identical to SEQ ID NO: 6185
  derived and/or modified CDS sequence (AUadapt) from InfluenzaA__ADN89413__HA

SEQ ID NO: 6225 - RNA, 1698 nt, Artificial Sequence; identical to SEQ ID NO: 5758
  derived and/or modified CDS sequence (AUadapt) from InfluenzaA__ADN89424__HA

SEQ ID NO: 6226 - RNA, 1698 nt, Artificial Sequence
  derived and/or modified CDS sequence (AUadapt) from InfluenzaA__ADN89435__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccucguggcccaaccacacggucaccgggguguccgccagcugcucccacaacggcgagaacagcuucuaccgcaaccugcuguggcucaccgggaagaacggccuguaccccaaccuguccaagucguacgccaacaacaaggagaaggaggugcucguccuguggggcgugcaccacccgcccaacaucgccgaccagaagacccuguaccacacggagaacgccuacguguccgucgugagcagccacuacucccggaaguucacccccgagaucgccaagcgccccaaggugcgggaccaggagggccgcaucaacuacuacuggacccuccuggagcccggcgacaccaucaucuucgaggcgaacgggaaccugaucgccccgcgguacgccuucgcccucucgcgcggcuucggguccggcaucaucaacagcaacgcccccauggacaagugcgacgcgaagugccagacgccccagggcgccaucaacuccagccugcccuuccagaacguccacccggugaccaucggggagugccccaaguacgugcgguccgccaagcugcgcauggucaccggccuccggaacauccccucgauccagucccgcgggcuguucggcgccaucgccggguucaucgagggcggcuggaccgggaugguggacggcugguacggguaccaccaccagaacgagcagggcagcggguacgcggccgaccagaaguccacgcagaacgccaucaacggcaucaccaacaaggugaacagcgucaucgagaagaugaacacccaguucaccgccgugggcaaggaguucaacaagcuggagcggcgcauggagaaccucaacaagaaggucgacgacggguucaucgacaucuggacguacaacgccgagcugcuggugcuccuggagaacgagcggacccuggacuuccacgacuccaacgugaagaaccucuacgagaaggucaagucgcagcugaagaacaacgcgaaggagaucggcaacgggugcuucgaguucuaccacaagugcaacgacgagugcauggaguccgugaagaacggcaccuacgacuaccccaaguacagcgaggagucccgccugaaccgggagaagaucgacggggugaagcucgagagcaugggcgucuaccagauccuggccaucuacuccaccguggccucgagccuggugcuccuggucucccugggcgccaucagcuucuggaugugcuccaacgggagccuccagugccgcaucugcaucuga

SEQ ID NO: 6227 - RNA, 1698 nt, Artificial Sequence
  derived and/or modified CDS sequence (AUadapt) from InfluenzaA__ADN89446__HA
augaaggccaagcugcucgugcugcugugcaccuucaccgccacguacgcggacaccaucugcaucggcuaccacgccaacaacucgaccgacaccgucgacacggugcucgagaagaacgugaccgucacccacuccgugaaccugcuggagaacagccacaacgggaagcucugccugcugaagggcaucgcgccccuccagcuggggaacugcuccguggccggcuggauccuggggaacccggagugcgagcuccugaucucgaaggaguccuggagcuacaucgucgagaagcccaaccccgagaacgggaccugcuaccccggccacuucgccgacuacgaggagcugcgcgagcagcucuccagcguguccucguucgagcgguucgagaucuucccgaaggaguccagcuggcccaaccacacggugaccggggucuccgccagcugcucccacaacggcgagaacucguucuaccgcaaccugcuguggcucaccgggaagaacggccuguaccccaaccuguccaagagcuacgccaacaacaaggagaaggaggugcucgugcuguggggcguccaccacccgcccaacaucgccgaccagaagacccuguaccacacggagaacgccuacguguccguggucagcucgcacuacucccggaaguucacccccgagaucgcgaagcgccccaaggugcgggaccaggagggccgcaucaacuacuacuggacccuccuggagcccggcgacaccaucaucuucgaggccaacgggaaccugaucgccccgcgguacgccuucgcccucagccgcggcuucggguccggcaucaucaacucgaacgcgcccauggacaagugcgacgccaagugccagacgccccagggcgccaucaacuccagccugcccuuccagaacgugcacccggucaccaucggggagugccccaaguacgugcgguccgccaagcugcgcauggugaccggccuccggaacauccccagcauccagucccgcgggcuguucggcgccaucgcgggguucaucgagggcggcuggaccgggauggucgacggcugguacggguaccaccaccagaacgagcagggcucgggguacgccgccgaccagaaguccacgcagaacgccaucaacggcaucaccaacaaggugaacagcgugaucgagaagaugaacacccaguucaccgccgucggcaaggaguucaacaagcuggagcggcgcauggagaaccucaacaagaagguggacgacggguucaucgacaucuggacguacaacgcggagcugcugguccuccuggagaacgagcggacccuggacuuccacgacuccaacgugaagaaccucuacgagaaggucaagagccagcugaagaacaacgccaaggagaucggcaacgggugcuucgaguucuaccacaagugcaacgacgagugcauggaguccgugaagaacggcaccuacgacuaccccaaguacucggaggaguccaagcugaaccgcgagaagaucgacggggugaagcucgagagcaugggcguguaccagauccuggccaucuacuccaccgucgccagcucgcuggugcuccuggugucccugggcgccaucagcuucuggaugugcuccaacgggagccuccagugccggaucugcaucuga

SEQ ID NO: 6228 - RNA, 1698 nt, Artificial Sequence; identical to SEQ ID NO: 5758
  derived and/or modified CDS sequence (AUadapt) from InfluenzaA__ADN89457__HA

SEQ ID NO: 6229 - RNA, 1698 nt, Artificial Sequence
  derived and/or modified CDS sequence (AUadapt) from InfluenzaA__ADN89468__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccucgguguccagcuucgagcgguucgagaucuucccgaaggacuccagcuggcccaaccacacggucaccgggguguccgccagcugcucccacaacggcgagucguccuucuaccgcaaccugcuguggcucaccgggaagaacggccuguaccccaaccugagcaaguccuacgccaacaacaaggagaaggaggugcucguccuguggggcgugcaccacccgcccagcaucaacgaccagaagacccuguaccacacggagaacgccuacgugagcgucguguccagccacuacucccggaaguucacccccgagaucgccaagcgccccaaggugcgggaccaggagggccgcaucaacuacuacuggacccuccuggagcccggcgacaccaucaucuucgaggccaacgggaaccugaucgcgccgcgguacgccuucgcccucucgcgcggcuucggguccggcaucaucaacagcaacgcccccauggacaagugcgacgccaagugccagacgccccagggcgcgaucaacuccagccugcccuuccagaacguccacccggugaccaucggggagugccccaaguacgugcgguccgccaagcugcgcauggucaccggccuccggaacauccccagcauccagucccgcgggcuguucggcgccaucgccggguucaucgagggcggcuggaccgggaugguggacggcugguacggguaccaccaccagaacgagcagggcucgggguacgccgcggaccagaaguccacgcagaacgccaucaacggcaucaccaacaaggugaacagcgucaucgagaagaugaacacccaguucaccgccgugggcaaggaguucuccaagcuggagcggcgcauggagaaccucaacaagaaggucgacgacggguucaucgacaucuggacguacaacgccgagcugcuggugcuccuggagaacgagcggacccuggacuuccacgacagcaacgugaagaaccucuacgagaaggucaagucccagcugaagaacaacgccaaggagaucggcaacgggugcuucgaguucuaccacaagugcaacgacgagugcauggagagcgugaagaacggcaccuacgacuaccccaaguacuccgaggagucgaagcugaaccgcgagaagaucgacggggugaagcucgagagcaugggcgucuaccagauccugaccaucuacuccacgguggcgagcucccuggugcuccugaucagccugggcgccaucuccuucuggaugugcagcaacgggucccuccagugccggaucugcaucuga

SEQ ID NO: 6230 - RNA, 1698 nt, Artificial Sequence; identical to SEQ ID NO: 6187
  derived and/or modified CDS sequence (AUadapt) from InfluenzaA__ADN89479__HA

SEQ ID NO: 6231 - RNA, 1698 nt, Artificial Sequence; identical to SEQ ID NO: 6187
  derived and/or modified CDS sequence (AUadapt) from InfluenzaA__ADN89490__HA

SEQ ID NO: 6232 - RNA, 1698 nt, Artificial Sequence; identical to SEQ ID NO: 6210
  derived and/or modified CDS sequence (AUadapt) from InfluenzaA__ADN89501__HA

SEQ ID NO: 6233 - RNA, 1698 nt, Artificial Sequence; identical to SEQ ID NO: 6198
  derived and/or modified CDS sequence (AUadapt) from InfluenzaA__ADN89512__HA

SEQ ID NO: 6234 - RNA, 1698 nt, Artificial Sequence; identical to SEQ ID NO: 6212
  derived and/or modified CDS sequence (AUadapt) from InfluenzaA__ADN89523__HA

SEQ ID NO: 6235 - RNA, 1698 nt, Artificial Sequence; identical to SEQ ID NO: 6221
  derived and/or modified CDS sequence (AUadapt) from InfluenzaA__ADN89534__HA

SEQ ID NO: 6236 - RNA, 1698 nt, Artificial Sequence; identical to SEQ ID NO: 6226
  derived and/or modified CDS sequence (AUadapt) from InfluenzaA__ADN89545__HA

SEQ ID NO: 6237 - RNA, 1698 nt, Artificial Sequence; identical to SEQ ID NO: 3871
  derived and/or modified CDS sequence (AUadapt) from InfluenzaA__ADN89556__HA

SEQ ID NO: 6238 - RNA, 1698 nt, Artificial Sequence; identical to SEQ ID NO: 6187
  derived and/or modified CDS sequence (AUadapt) from InfluenzaA__ADN89567__HA

SEQ ID NO: 6239 - RNA, 1698 nt, Artificial Sequence
  derived and/or modified CDS sequence (AUadapt) from InfluenzaA__ADN89578__HA
augaaggugaagcugcucguccugcugugcacccucaccgccacguacgccgacaccaucugcaucggcuaccacgcgaacaacucgaccgacaccguggacacggugcuggagaagaacgucaccgugacccacuccgugaaccugcucgagaacagccacaacgggaagcugugccugcucaagggcaucgcgccccugcagcuggggaacugcuccgucgccggcuggauccucgggaacccggagugcgagcugcugaucucgaaggaguccuggagcuacaucguggagaagcccaaccccgagaacgggaccugcuaccccggccacuucgccgacuacgaggagcuccgcgagcagcuguccagcguguccucguucgagcgguucgagaucuucccgaagggcuccagcuggcccaaccacacggucaccggcguguccgccagcugcucccacaacggggagaacucguucuaccgcaaccugcucuggcugaccggcaagaacgggcuguaccccaaccucuccaagagcuacgccaacaacaaggagaaggaggugcugcugcucuggggcguccaccacccgcccaacaucgccgaccagaagacccuguaccacacggagaacgccuacguguccguggucagcucgcacuacucccggaaguucacccccgagaucgccaagcgccccaaggugcgggaccaggagggccgcaucaacuacuacuggacccugcucgagcccggggacaccaucaucuucgaggcgaacggcaaccugaucgccccgcgguacgccuucgcccugagccgcggguucggcuccggcaucaucaacucgaacgcccccauggacaagugcgacgcgaagugccagacgccccagggggccaucaacuccagccuccccuuccagaacgugcacccggucaccaucggcgagugccccaaguacgugcgguccgccaagcugcgcauggugaccgggcugcggaacauccccagcauccagucccgcggccucuucggggccaucgccggcuucaucgagggcggguggaccggcauggucgacgggugguacggcuaccaccaccagaacgagcaggggucgggcuacgcggccgaccagaaguccacgcagaacgccaucaacggcaucaccaacaaggugaacagcgugaucgagaagaugaacacccaguucaccgccgucgggaaggaguucaacaagcuggagcggcgcauggagaaccugaacaagaagguggacgacggcuucaucgacaucuggacguacaacgccgagcuccugguccugcucgagaacgagcggacccuggacuuccacgacuccaacgugaagaaccuguacgagaaggucaagagccagcucaagaacaacgcgaaggagaucgggaacggcugcuucgaguucuaccacaagugcaacgacgagugcauggaguccgugaagaacgggaccuacgacuaccccaaguacucggaggaguccaagcugaaccgcgagaagaucgacggcgugaagcuggagagcaugggcguguaccagauccucgccaucuacuccaccgucgccagcucgcuggugcugcucgugucccugggggccaucagcuucuggaugugcuccaacggcagccugcagugccggaucugcaucuga

SEQ ID NO: 6240 - RNA, 1698 nt, Artificial Sequence; identical to SEQ ID NO: 5758
  derived and/or modified CDS sequence (AUadapt) from InfluenzaA__ADN89589__HA

SEQ ID NO: 6241 - RNA, 1698 nt, Artificial Sequence
  derived and/or modified CDS sequence (AUadapt) from InfluenzaA__ADN89600__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccucgguguccagcuucgagcgguucgagaucuucccgaaggaguccagcuggcccaaccacacggucaccggcguguccgccagcugcucccacaacggcgagucguccuucuaccgcaaccugcuguggcucacccggaagaacgggcuguaccccaaccugagcaaguccuacgccaacaacaaggagaaggaggugcucguccuguggggcgugcaccacccgcccaacaugguggaccagaagacccuguaccgcacggagaacgccuacgucagcguggugagcucccacuacucgcggaaguucacccccgagaucgccaagcgccccaagguccgggaccaggaggggcgcaucaacuacuacuggacccuccuggagcccggcgacaccaucaucuucgaggccaacggcaaccugaucgcgccgcgguacgccuucgcccucucccgcggguucggcagcgggaucaucaacuccaacgcccccaugggcaagugcgacgccaagugccagacgccccagggcgcgaucaacagcucccugcccuuccagaacgugcacccggugaccaucggggagugccccaaguacguccggagcgccaagcugcgcauggugaccggccuccggaacauccccuccauccagucgcgcgggcuguucggcgccaucgccggguucaucgagggcggcuggaccgggaugguggacggcugguacggguaccaccaccagaacgagcagggcuccggguacgccgcggaccagaaguccacgcagaacgccaucaacggcaucaccaacaaggucaacagcgugaucgagaagaugaacacccaguucaccgccgucggcaaggaguucaacaagcuggagcggcgcauggagaaccucaacaagaagguggacgacggguucaucgacaucuggacguacaacgccgagcugcuggugcuccuggagaacgagcggacccuggacuuccacgacagcaacgucaagaaccucuacgagaaggugaagucccagcugaagaacaacgccaaggagaucggcaacgggugcuucgaguucuaccacaagugcaacgacgagugcauggagagcgugaagaacggcaccuacgacuaccccaaguacuccgaggagucgaagcugaaccgcgagaagaucgacggggucaagcucgaguccaugggcguguaccagauccuggcgaucuacagcaccguggccagcucccugguccuccuggugagccugggcgccaucuccuucuggaugugcagcaacgggucccuccagugccggaucugcaucuga

SEQ ID NO: 6242 - RNA, 1698 nt, Artificial Sequence; identical to SEQ ID NO: 5758
  derived and/or modified CDS sequence (AUadapt) from InfluenzaA__ADN89611__HA

SEQ ID NO: 6243 - RNA, 1698 nt, Artificial Sequence; identical to SEQ ID NO: 6185
  derived and/or modified CDS sequence (AUadapt) from InfluenzaA__ADN89622__HA

SEQ ID NO: 6244 - RNA, 1698 nt, Artificial Sequence; identical to SEQ ID NO: 6226
  derived and/or modified CDS sequence (AUadapt) from InfluenzaA__ADN89633__HA

SEQ ID NO: 6245 - RNA, 1698 nt, Artificial Sequence; identical to SEQ ID NO: 6210
  derived and/or modified CDS sequence (AUadapt) from InfluenzaA__ADN89644__HA

SEQ ID NO: 6246 - RNA, 1698 nt, Artificial Sequence; identical to SEQ ID NO: 6226
  derived and/or modified CDS sequence (AUadapt) from InfluenzaA__ADN89655__HA

SEQ ID NO: 6247 - RNA, 1698 nt, Artificial Sequence; identical to SEQ ID NO: 5758
  derived and/or modified CDS sequence (AUadapt) from InfluenzaA__ADN89666__HA

SEQ ID NO: 6248 - RNA, 1698 nt, Artificial Sequence; identical to SEQ ID NO: 6198
  derived and/or modified CDS sequence (AUadapt) from InfluenzaA__ADN89677__HA

SEQ ID NO: 6249 - RNA, 1698 nt, Artificial Sequence; identical to SEQ ID NO: 6198
  derived and/or modified CDS sequence (AUadapt) from InfluenzaA__ADN89688__HA

SEQ ID NO: 6250 - RNA, 1698 nt, Artificial Sequence; identical to SEQ ID NO: 6185
  derived and/or modified CDS sequence (AUadapt) from InfluenzaA__ADN89699__HA

SEQ ID NO: 6251 - RNA, 1698 nt, Artificial Sequence; identical to SEQ ID NO: 6187
  derived and/or modified CDS sequence (AUadapt) from InfluenzaA__ADN89710__HA

SEQ ID NO: 6252 - RNA, 1698 nt, Artificial Sequence; identical to SEQ ID NO: 6210
  derived and/or modified CDS sequence (AUadapt) from InfluenzaA__ADN89721__HA

SEQ ID NO: 6253 - RNA, 1698 nt, Artificial Sequence; identical to SEQ ID NO: 6187
  derived and/or modified CDS sequence (AUadapt) from InfluenzaA__ADN89732__HA

SEQ ID NO: 6254 - RNA, 1698 nt, Artificial Sequence; identical to SEQ ID NO: 6187
  derived and/or modified CDS sequence (AUadapt) from InfluenzaA__ADN89743__HA

SEQ ID NO: 6255 - RNA, 1698 nt, Artificial Sequence; identical to SEQ ID NO: 6212
  derived and/or modified CDS sequence (AUadapt) from InfluenzaA__ADN89765__HA

SEQ ID NO: 6256 - RNA, 1698 nt, Artificial Sequence
  derived and/or modified CDS sequence (AUadapt) from InfluenzaA__ADN89776__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccucgguguccagcuucgagcgguucgagaucuucccgaaggaguccagcuggcccaaccacacggucaccgggguguccgccagcugcucccacaacggcgagucguccuucuaccgcaaccugcuguggcucaccgggaagaacggccuguaccccaaccugagcaaguccuacgccaacaacaaggagaaggaggugcucguccuguggggcgugcaccacccgcccagcaucagcgaccagaagacccuguaccacacggagaacgccuacguguccgucgugagcucccacuacucgcggaaguucacccccgagguggccaagcgccccaagguccgggaccaggagggccgcaucaacuacuacuggacccuccuggagcccggcgacaccaucaucuucgaggccaacgggaaccugaucgcgccgcgguacgccuucgcccucucccgcggcuucgggagcggcaucaucaacuccaacgcccccauggacaagugcgacgccaagugccagacgccccagggcgcgaucaacagcucccugcccuuccagaacgugcacccggugaccaucggggagugccccaaguacguccggagcgccaagcugcgcauggugaccggccuccggaacauccccuccauccagucgcgcgggcuguucggcgccaucgccggguucaucgagggcggcuggaccgggaugguggacggcugguacggguaccaccaccagaacgagcagggcuccggguacgccgcggaccagaaguccacgcagaacgccaucaacggcaucaccaacaaggucaacagcgugaucgagaagaugaacacccaguucaccgccgucggcaaggaguucaacaagcuggagcggcgcauggagaaccucaacaagaagguggacgacggguucaucgacaucuggacguacaacgccgagcugcuggugcuccuggagaacgagcggacccuggacuuccacgacagcaacgucaagaaccucuacgagaaggugaagucccagcugaagaacaacgccaaggagaucggcaacgggugcuucgaguucuaccacaagugcaacgacgagugcauggagagcgugaagaacggcaccuacgacuaccccaaguacuccgaggagucgaagcugaaccgcgagaagaucgacggggucaagcucgagagcaugggcguguaccagauccuggcgaucuacuccaccguggccagcucccugguccuccuggugagccugggcgccaucuccuucuggaugugcagcaacgggucccuccagugccggaucugcaucuga

SEQ ID NO: 6257 - RNA, 1698 nt, Artificial Sequence; identical to SEQ ID NO: 6198
  derived and/or modified CDS sequence (AUadapt) from InfluenzaA__ADN89787__HA

SEQ ID NO: 6258 - RNA, 1698 nt, Artificial Sequence; identical to SEQ ID NO: 6212
  derived and/or modified CDS sequence (AUadapt) from InfluenzaA__ADN89798__HA

SEQ ID NO: 6259 - RNA, 1698 nt, Artificial Sequence; identical to SEQ ID NO: 5758
  derived and/or modified CDS sequence (AUadapt) from InfluenzaA__ADN89809__HA

SEQ ID NO: 6260 - RNA, 1698 nt, Artificial Sequence; identical to SEQ ID NO: 5758
  derived and/or modified CDS sequence (AUadapt) from InfluenzaA__ADN89820__HA

SEQ ID NO: 6261 - RNA, 1698 nt, Artificial Sequence; identical to SEQ ID NO: 5758
  derived and/or modified CDS sequence (AUadapt) from InfluenzaA__ADN89831__HA

SEQ ID NO: 6262 - RNA, 1698 nt, Artificial Sequence
  derived and/or modified CDS sequence (AUadapt) from InfluenzaA__ADN89842__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaaccgccacaacgggaagcucugccugcugaagggcaucgcgccccuccagcuggggaacugcagcgucgccggcuggauccuggggaacccggagugcgagcuccugaucuccaaggagagcugguccuacaucguggagaagcccaaccccgagaacgggaccugcuaccccggccacuucgccgacuacgaggagcugcgggagcagcucucguccgugagcuccuucgagcgcuucgagaucuucccgaaggagagcuccuggcccaaccacacggucaccggggugagcgccuccugcucgcacaacggcgaguccagcuucuaccggaaccugcuguggcucaccgggaagaacggccuguaccccaaccuguccaagagcuacgccaacaacaaggagaaggaggugcucguccuguggggcgugcaccacccgcccaacaucguggaccagaagacccuguaccgcacggagaacgccuacgucuccguggugucgagccacuacucccggaaguucacccccgagaucgccaagcgccccaagguccgggaccaggagggccgcaucaacuacuacuggacccuccuggagcccggcgacaccaucaucuucgaggccaacgggaaccugaucgcgccgcgguacgccuucgcccucagccgcggcuucggguccggcaucaucaacagcaacgcccccauggacaagugcgacgccaagugccagacgccccagggcgcgaucaacuccucgcugcccuuccagaacgugcacccggugaccaucggggagugccccaaguacguccgguccgccaagcugcgcauggugaccggccuccggaacauccccagcauccagucccgcgggcuguucggcgccaucgccggguucaucgagggcggcuggaccgggaugguggacggcugguacggguaccaccaccagaacgagcagggcagcggguacgccgcggaccagaaguccacgcagaacgccaucaacggcaucaccaacaaggucaacucggugaucgagaagaugaacacccaguucaccgccgucggcaaggaguucaacaagcuggagcggcgcauggagaaccucaacaagaagguggacgacggguucaucgacaucuggacguacaacgccgagcugcuggugcuccuggagaacgagcggacccuggacuuccacgacuccaacgucaagaaccucuacgagaaggucaagagccagcugaagaacaacgccaaggagaucggcaacgggugcuucgaguucuaccacaagugcaacgacgagugcauggaguccgugaagaacggcaccuacgacuaccccaaguacagcgaggaguccaagcugaaccgcgagaagaucgacggggugaagcucgagagcaugggcguguaccagauccuggcgaucuacuccaccguggccucgagccugguccuccuggugucccugggcgccaucagcuucuggaugugcuccaacgggagccuccagugccggaucugcaucuga

SEQ ID NO: 6263 - RNA, 1701 nt, Artificial Sequence; identical to SEQ ID NO: 5778
  derived and/or modified CDS sequence (AUadapt) from InfluenzaA__ADN89864__HA

SEQ ID NO: 6264 - RNA, 1701 nt, Artificial Sequence; identical to SEQ ID NO: 5778
  derived and/or modified CDS sequence (AUadapt) from InfluenzaA__ADN89875__HA

SEQ ID NO: 6265 - RNA, 1701 nt, Artificial Sequence
  derived and/or modified CDS sequence (AUadapt) from InfluenzaA__ADN89886__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcaggccgugaucccgaacaucggcagccggccccgcguccggaacauccccucccgcaucucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacccccaacggcuccauccccaacgacaagccguuccagaacgugaaccgcaucacguacggggcgugcccccgguacgucaagcagucgacccugaagcucgccaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgcggaccugaaguccacgcaggccgccaucgaccagaucaacgggaagcugaaccgccucaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacaccaucgaccucacggacuccgagaugaacaagcuguucgagaagacccgcaagcagcugcgcgagaacgcggaggacauggggaacggcugcuucaccaucuaccacaagugcgacaacgccugcaucgggucgauccggaacggcaccuacgaccacaacgucuaccgcgacgaggcccucaacaaccgguuccagaucaaggggguggagcugaaguccggcuacaaggacuggauccuguggaucagcuucgccaucuccugcuuccuccugugcguggcccugcucggcuucaucaugugggcgugccagaaggggaacauccgcugcaacaucugcaucuga

SEQ ID NO: 6266 - RNA, 1701 nt, Artificial Sequence; identical to SEQ ID NO: 5778
  derived and/or modified CDS sequence (AUadapt) from InfluenzaA__ADN89897__HA

SEQ ID NO: 6267 - RNA, 1701 nt, Artificial Sequence; identical to SEQ ID NO: 5778
  derived and/or modified CDS sequence (AUadapt) from InfluenzaA__ADN89908__HA

SEQ ID NO: 6268 - RNA, 1701 nt, Artificial Sequence; identical to SEQ ID NO: 5778
  derived and/or modified CDS sequence (AUadapt) from InfluenzaA__ADN89919__HA

SEQ ID NO: 6269 - RNA, 1701 nt, Artificial Sequence; identical to SEQ ID NO: 5778
  derived and/or modified CDS sequence (AUadapt) from InfluenzaA__ADN89930__HA

SEQ ID NO: 6270 - RNA, 1701 nt, Artificial Sequence; identical to SEQ ID NO: 5778
  derived and/or modified CDS sequence (AUadapt) from InfluenzaA__ADN89941__HA

SEQ ID NO: 6271 - RNA, 1701 nt, Artificial Sequence; identical to SEQ ID NO: 5778
  derived and/or modified CDS sequence (AUadapt) from InfluenzaA__ADN89952__HA

SEQ ID NO: 6272 - RNA, 1701 nt, Artificial Sequence; identical to SEQ ID NO: 5778
  derived and/or modified CDS sequence (AUadapt) from InfluenzaA__ADN89963__HA

SEQ ID NO: 6273 - RNA, 1701 nt, Artificial Sequence
  derived and/or modified CDS sequence (AUadapt) from InfluenzaA__ADN89974__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcaggccgugaucccgaacaucggcagccggccccgcguccggaacauccccucccgcaucucgaucuacuggaccaucgugaagcccggcgacauccugcucaucaacuccaccgggaaccugaucgccccgcggggcuacuucaagauccagagcgggaaguccucgaucaugcgcuccgacgcccccaucggcaagugcaacagcgagugcaucacccccaacggcuccauccccaacgacaagccguuccagaacgugaaccggaucacguacggggcgugcccccgcuacgucaagcagucgacccugaagcucgccaccggcaugcggaacgugcccgagaagcagacccgcgggaucuucggcgccaucgccggguucaucgagaacggcugggagggcaugguggacgggugguacggcuuccggcaccagaacuccgaggggcgcggccaggccgcggaccugaaguccacgcaggccgccaucgaccagaucaacgggaagcugaaccggcucaucggcaagaccaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacaccaucgaccucacggacuccgagaugaacaagcuguucgagaagaccaagaagcagcugcgggagaacgcggaggacauggggaacggcugcuucaccaucuaccacaagugcgacaacgccugcaucgggucgauccgcaacggcaccuacgaccacaacgucuaccgcgacgaggcccucaacaaccgguuccagaucaaggggguggagcugaaguccggcuacaaggacuggauccuguggaucagcuucgccaucuccugcuuccuccugugcguggcccugcucggcuucaucaugugggcgugccagaaggggaacauccgcugcaacaucugcaucuga

SEQ ID NO: 6274 - RNA, 1701 nt, Artificial Sequence; identical to SEQ ID NO: 5778
  derived and/or modified CDS sequence (AUadapt) from InfluenzaA__ADN89985__HA

SEQ ID NO: 6275 - RNA, 1701 nt, Artificial Sequence; identical to SEQ ID NO: 5778
  derived and/or modified CDS sequence (AUadapt) from InfluenzaA__ADN89996__HA

SEQ ID NO: 6276 - RNA, 1701 nt, Artificial Sequence; identical to SEQ ID NO: 5778
  derived and/or modified CDS sequence (AUadapt) from InfluenzaA__ADN90007__HA

SEQ ID NO: 6277 - RNA, 1701 nt, Artificial Sequence; identical to SEQ ID NO: 5778
  derived and/or modified CDS sequence (AUadapt) from InfluenzaA__ADN90018__HA

SEQ ID NO: 6278 - RNA, 1701 nt, Artificial Sequence; identical to SEQ ID NO: 5778
  derived and/or modified CDS sequence (AUadapt) from InfluenzaA__ADN90040__HA

SEQ ID NO: 6279 - RNA, 1701 nt, Artificial Sequence; identical to SEQ ID NO: 5778
  derived and/or modified CDS sequence (AUadapt) from InfluenzaA__ADN90051__HA

SEQ ID NO: 6280 - RNA, 1701 nt, Artificial Sequence; identical to SEQ ID NO: 5778
  derived and/or modified CDS sequence (AUadapt) from InfluenzaA__ADN90062__HA

SEQ ID NO: 6281 - RNA, 1701 nt, Artificial Sequence; identical to SEQ ID NO: 5778
  derived and/or modified CDS sequence (AUadapt) from InfluenzaA__ADN90073__HA

SEQ ID NO: 6282 - RNA, 1701 nt, Artificial Sequence; identical to SEQ ID NO: 5778
  derived and/or modified CDS sequence (AUadapt) from InfluenzaA__ADN90084__HA

SEQ ID NO: 6283 - RNA, 1701 nt, Artificial Sequence; identical to SEQ ID NO: 5778
  derived and/or modified CDS sequence (AUadapt) from InfluenzaA__ADN90095__HA

SEQ ID NO: 6284 - RNA, 1701 nt, Artificial Sequence; identical to SEQ ID NO: 5778
  derived and/or modified CDS sequence (AUadapt) from InfluenzaA__ADN90106__HA

SEQ ID NO: 6285 - RNA, 1701 nt, Artificial Sequence; identical to SEQ ID NO: 5778
  derived and/or modified CDS sequence (AUadapt) from InfluenzaA__ADN90117__HA

SEQ ID NO: 6286 - RNA, 1701 nt, Artificial Sequence; identical to SEQ ID NO: 5778
  derived and/or modified CDS sequence (AUadapt) from InfluenzaA__ADN90128__HA

SEQ ID NO: 6287 - RNA, 1701 nt, Artificial Sequence; identical to SEQ ID NO: 5778
  derived and/or modified CDS sequence (AUadapt) from InfluenzaA__ADN90139__HA

SEQ ID NO: 6288 - RNA, 1701 nt, Artificial Sequence; identical to SEQ ID NO: 5778
  derived and/or modified CDS sequence (AUadapt) from InfluenzaA__ADN90150__HA

SEQ ID NO: 6289 - RNA, 1701 nt, Artificial Sequence; identical to SEQ ID NO: 5778
  derived and/or modified CDS sequence (AUadapt) from InfluenzaA__ADN90161__HA

SEQ ID NO: 6290 - RNA, 1701 nt, Artificial Sequence; identical to SEQ ID NO: 5778
  derived and/or modified CDS sequence (AUadapt) from InfluenzaA__ADN90172__HA

SEQ ID NO: 6291 - RNA, 1701 nt, Artificial Sequence; identical to SEQ ID NO: 5778
  derived and/or modified CDS sequence (AUadapt) from InfluenzaA__ADN90183__HA

SEQ ID NO: 6292 - RNA, 1701 nt, Artificial Sequence; identical to SEQ ID NO: 5778
  derived and/or modified CDS sequence (AUadapt) from InfluenzaA__ADN90194__HA

SEQ ID NO: 6293 - RNA, 1701 nt, Artificial Sequence; identical to SEQ ID NO: 5778
  derived and/or modified CDS sequence (AUadapt) from InfluenzaA__ADN90205__HA

SEQ ID NO: 6294 - RNA, 1701 nt, Artificial Sequence; identical to SEQ ID NO: 5778
  derived and/or modified CDS sequence (AUadapt) from InfluenzaA__ADN90216__HA

SEQ ID NO: 6295 - RNA, 1701 nt, Artificial Sequence; identical to SEQ ID NO: 3675
  derived and/or modified CDS sequence (AUadapt) from InfluenzaA__ADN92467__HA

SEQ ID NO: 6296 - RNA, 1701 nt, Artificial Sequence
  derived and/or modified CDS sequence (AUadapt) from InfluenzaA__ADN92478__HA
augaagaccaucaucgcccugucgcacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcaagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaagaacucguucuucucccgccugaacuggcucacgcaccugaacuucaaguaccaggcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcagaccgugauccccaacaucggcucgcggccgcgcguccggaacauccccucccgcaucagcaucuacuggaccaucgugaagcccggcgacauccugcucaucaacuccaccgggaaccugaucgcgccccggggcuacuucaagauccagucggggaaguccagcaucaugcgcuccgacgccccgaucggcaagugcaacucggagugcaucacgcccaacggcuccauccccaacgacaagcccuuccagaacgugaaccggaucaccuacggggccugcccgcgcuacgucaagcagaacacccugaagcucgccaccggcaugcggaacgugcccgagaagcagacgcgcgggaucuucggcgccaucgccggguucaucgagaacggcugggagggcaugguggacgggugguacggcuuccggcaccagaacucggaggggcgcggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 6297 - RNA, 1701 nt, Artificial Sequence
  derived and/or modified CDS sequence (AUadapt) from InfluenzaA__ADN92489__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccucguccggcacgcuggaguucaacaacgagaacuucaacuggaccggggugacccagaacggcaccagcuccgccugcauccgccggucgaagaacuccuucuucagccgccugaacuggcucacgcaccugaacuucaaguaccaggcccugaacgugaccaugcccaacaacgagcaguucgacaagcucuacaucuggggcguccaccaccccgggaccgacaaggaccagaucuuccuguacgcgcaggccuccgggcggaucaccgugucgacgaagcgcucccagcagaccgugauccccaacaucggcucgcggccgcgcguccggaacauccccagccgcaucuccaucuacuggaccaucgugaagcccggcgacauccugcucaucaacucgaccgggaaccugaucgcgccccggggcuacuucaagauccaguccgggaaguccuccaucaugcgcagcgacgccccgaucggcaagugcaacuccgagugcaucacgcccaacggcucgauccccaacgacaagcccuuccagaacgugaaccggaucaccuacggggccugcccgcgcuacgucaagcagaacacccugaagcucgccaccggcaugcggaacgugcccgagaagcagacgcgcgggaucuucggcgccaucgccggguucaucgagaacggcugggagggcaugguggacgggugguacggcuuccggcaccagaacuccgaggggcgcggccaggccgccgaccucaagucgacccaggcggccaucgaccagaucaacgggaagcugaaccggcugaucggcaagaccaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgggagaacgccgaggacauggggaacggcugcuucaagaucuaccacaagugcgacaacgcgugcaucgggucgauccgcaacggcaccuacgaccacgacgucuaccgcgacgaggcccucaacaaccgguuccagaucaaggggguggagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 6298 - RNA, 1701 nt, Artificial Sequence; identical to SEQ ID NO: 3675
  derived and/or modified CDS sequence (AUadapt) from InfluenzaA__ADN92500__HA

SEQ ID NO: 6299 - RNA, 1701 nt, Artificial Sequence; identical to SEQ ID NO: 116
  derived and/or modified CDS sequence (AUadapt) from InfluenzaA__ADN92510__HA

SEQ ID NO: 6300 - RNA, 1701 nt, Artificial Sequence; identical to SEQ ID NO: 116
  derived and/or modified CDS sequence (AUadapt) from InfluenzaA__ADN92520__HA

SEQ ID NO: 6301 - RNA, 1701 nt, Artificial Sequence; identical to SEQ ID NO: 4016
  derived and/or modified CDS sequence (AUadapt) from InfluenzaA__ADN92530__HA

SEQ ID NO: 6302 - RNA, 1701 nt, Artificial Sequence; identical to SEQ ID NO: 3156
  derived and/or modified CDS sequence (AUadapt) from InfluenzaA__ADN92540__HA

SEQ ID NO: 6303 - RNA, 1701 nt, Artificial Sequence; identical to SEQ ID NO: 116
  derived and/or modified CDS sequence (AUadapt) from InfluenzaA__ADN92550__HA

SEQ ID NO: 6304 - RNA, 1701 nt, Artificial Sequence; identical to SEQ ID NO: 116
  derived and/or modified CDS sequence (AUadapt) from InfluenzaA__ADN92560__HA

SEQ ID NO: 6305 - RNA, 1701 nt, Artificial Sequence
  derived and/or modified CDS sequence (AUadapt) from InfluenzaA__ADO00730__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcggcucgcuguccaccgccagcuccuggucguacaucguggagaccuccagcuccgacaacggcacgugcuaccccggggacuucaucgacuacgaggagcuccgggagcagcugucguccgugagcuccuucgagcgcuucgagaucuuccccaagaccucguccuggcccaaccacgacagcaacaagggcgucaccgccgccugcccgcacgccggggcgaaguccuucuacaagaaccugaucuggcucgugaagaagggcaacucguaccccaagcuguccaagagcuacaucaacgacaaggggaaggaggugcugguccucuggggcauccaccaccccucgaccuccgccgaccagcagagccuguaccagaacgccgacgccuacguguucgugggcacgucccgguacucgaagaaguucaagcccgagaucgccauccgcccgaagguccgggaccaggaggggcgcaugaacuacuacuggacccugguggagcccggcgacaagaucaccuucgaggcgaccgggaaccucguggucccccgguacgccuucgccauggagcgcaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagucgaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagucgacccagaacgcgaucgacggcaucaccaacaaggugaacuccgucaucgagaagaugaacacccaguucacggccguggggaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggcgccaucucguucuggaugugcuccaacgggagccugcagugccggaucugcaucuga

SEQ ID NO: 6306 - RNA, 1701 nt, Artificial Sequence; identical to SEQ ID NO: 4334
  derived and/or modified CDS sequence (AUadapt) from InfluenzaA__ADO00740__HA

SEQ ID NO: 6307 - RNA, 1701 nt, Artificial Sequence; identical to SEQ ID NO: 4078
  derived and/or modified CDS sequence (AUadapt) from InfluenzaA__ADO00750__HA

SEQ ID NO: 6308 - RNA, 1701 nt, Artificial Sequence; identical to SEQ ID NO: 116
  derived and/or modified CDS sequence (AUadapt) from InfluenzaA__ADO12143__HA

SEQ ID NO: 6309 - RNA, 1701 nt, Artificial Sequence; identical to SEQ ID NO: 116
  derived and/or modified CDS sequence (AUadapt) from InfluenzaA__ADO12153__HA

SEQ ID NO: 6310 - RNA, 1701 nt, Artificial Sequence; identical to SEQ ID NO: 116
  derived and/or modified CDS sequence (AUadapt) from InfluenzaA__ADO12163__HA

SEQ ID NO: 6311 - RNA, 1701 nt, Artificial Sequence; identical to SEQ ID NO: 116
  derived and/or modified CDS sequence (AUadapt) from InfluenzaA__ADO12173__HA

SEQ ID NO: 6312 - RNA, 1701 nt, Artificial Sequence; identical to SEQ ID NO: 116
  derived and/or modified CDS sequence (AUadapt) from InfluenzaA__ADO12183__HA

SEQ ID NO: 6313 - RNA, 1701 nt, Artificial Sequence; identical to SEQ ID NO: 116
  derived and/or modified CDS sequence (AUadapt) from InfluenzaA__ADO12193__HA

SEQ ID NO: 6314 - RNA, 1701 nt, Artificial Sequence; identical to SEQ ID NO: 116
  derived and/or modified CDS sequence (AUadapt) from InfluenzaA__ADO12203__HA

SEQ ID NO: 6315 - RNA, 1701 nt, Artificial Sequence; identical to SEQ ID NO: 116
  derived and/or modified CDS sequence (AUadapt) from InfluenzaA__ADO12213__HA

SEQ ID NO: 6316 - RNA, 1701 nt, Artificial Sequence; identical to SEQ ID NO: 116
  derived and/or modified CDS sequence (AUadapt) from InfluenzaA__ADO12223__HA

SEQ ID NO: 6317 - RNA, 1701 nt, Artificial Sequence; identical to SEQ ID NO: 116
  derived and/or modified CDS sequence (AUadapt) from InfluenzaA__ADO12233__HA

SEQ ID NO: 6318 - RNA, 1701 nt, Artificial Sequence; identical to SEQ ID NO: 116
  derived and/or modified CDS sequence (AUadapt) from InfluenzaA__ADO12243__HA

SEQ ID NO: 6319 - RNA, 1701 nt, Artificial Sequence; identical to SEQ ID NO: 116
  derived and/or modified CDS sequence (AUadapt) from InfluenzaA__ADO12253__HA

SEQ ID NO: 6320 - RNA, 1701 nt, Artificial Sequence; identical to SEQ ID NO: 116
  derived and/or modified CDS sequence (AUadapt) from InfluenzaA__ADO12263__HA

SEQ ID NO: 6321 - RNA, 1701 nt, Artificial Sequence; identical to SEQ ID NO: 116
  derived and/or modified CDS sequence (AUadapt) from InfluenzaA__ADO12273__HA

SEQ ID NO: 6322 - RNA, 1701 nt, Artificial Sequence; identical to SEQ ID NO: 116
  derived and/or modified CDS sequence (AUadapt) from InfluenzaA__ADO12283__HA

SEQ ID NO: 6323 - RNA, 1701 nt, Artificial Sequence; identical to SEQ ID NO: 116
  derived and/or modified CDS sequence (AUadapt) from InfluenzaA__ADO12293__HA

SEQ ID NO: 6324 - RNA, 1701 nt, Artificial Sequence; identical to SEQ ID NO: 116
  derived and/or modified CDS sequence (AUadapt) from InfluenzaA__ADO12303__HA

SEQ ID NO: 6325 - RNA, 1701 nt, Artificial Sequence; identical to SEQ ID NO: 116
  derived and/or modified CDS sequence (AUadapt) from InfluenzaA__ADO12313__HA

SEQ ID NO: 6326 - RNA, 1701 nt, Artificial Sequence; identical to SEQ ID NO: 116
  derived and/or modified CDS sequence (AUadapt) from InfluenzaA__ADO12323__HA

SEQ ID NO: 6327 - RNA, 1701 nt, Artificial Sequence; identical to SEQ ID NO: 116
  derived and/or modified CDS sequence (AUadapt) from InfluenzaA__ADO12333__HA

SEQ ID NO: 6328 - RNA, 1701 nt, Artificial Sequence; identical to SEQ ID NO: 116
  derived and/or modified CDS sequence (AUadapt) from InfluenzaA__ADO12343__HA

SEQ ID NO: 6329 - RNA, 1701 nt, Artificial Sequence; identical to SEQ ID NO: 116
  derived and/or modified CDS sequence (AUadapt) from InfluenzaA__ADO12353__HA

SEQ ID NO: 6330 - RNA, 1701 nt, Artificial Sequence; identical to SEQ ID NO: 116
  derived and/or modified CDS sequence (AUadapt) from InfluenzaA__ADO12363__HA

SEQ ID NO: 6331 - RNA, 1701 nt, Artificial Sequence
  derived and/or modified CDS sequence (AUadapt) from InfluenzaA__ADO12373__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacaacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 6332 - RNA, 1701 nt, Artificial Sequence; identical to SEQ ID NO: 4399
  derived and/or modified CDS sequence (AUadapt) from InfluenzaA__ADO12383__HA

SEQ ID NO: 6333 - RNA, 1701 nt, Artificial Sequence
  derived and/or modified CDS sequence (AUadapt) from InfluenzaA__ADO12403__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacgugcaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggucaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgucaagcucgagagcacccgcaucuaccagauccuggcgaucuacuccaccguggccucgagccuggugcucgucgugucccugggggccaucucguucuggaugugcuccaacggcagccugcagugccggaucugcaucuga

SEQ ID NO: 6334 - RNA, 1701 nt, Artificial Sequence; identical to SEQ ID NO: 4550
  derived and/or modified CDS sequence (AUadapt) from InfluenzaA__ADO12413__HA

SEQ ID NO: 6335 - RNA, 1701 nt, Artificial Sequence; identical to SEQ ID NO: 116
  derived and/or modified CDS sequence (AUadapt) from InfluenzaA__ADO12423__HA

SEQ ID NO: 6336 - RNA, 1701 nt, Artificial Sequence; identical to SEQ ID NO: 116
  derived and/or modified CDS sequence (AUadapt) from InfluenzaA__ADO12433__HA

SEQ ID NO: 6337 - RNA, 1701 nt, Artificial Sequence; identical to SEQ ID NO: 116
  derived and/or modified CDS sequence (AUadapt) from InfluenzaA__ADO12443__HA

SEQ ID NO: 6338 - RNA, 1701 nt, Artificial Sequence; identical to SEQ ID NO: 116
  derived and/or modified CDS sequence (AUadapt) from InfluenzaA__ADO12453__HA

SEQ ID NO: 6339 - RNA, 1701 nt, Artificial Sequence; identical to SEQ ID NO: 116
  derived and/or modified CDS sequence (AUadapt) from InfluenzaA__ADO12463__HA

SEQ ID NO: 6340 - RNA, 1701 nt, Artificial Sequence
  derived and/or modified CDS sequence (AUadapt) from InfluenzaA__ADO12473__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcagaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 6341 - RNA, 1701 nt, Artificial Sequence; identical to SEQ ID NO: 116
  derived and/or modified CDS sequence (AUadapt) from InfluenzaA__ADO12493__HA

SEQ ID NO: 6342 - RNA, 1701 nt, Artificial Sequence
  derived and/or modified CDS sequence (AUadapt) from InfluenzaA__ADO12503__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgacccgcaucuaccagauccuggcgaucuacuccaccgucgccagcucgcuggugcucguggucucccugggggccaucaacuucuggaugugcagcaacggcucccugcagugccggaucugcaucuga

SEQ ID NO: 6343 - RNA, 1701 nt, Artificial Sequence
  derived and/or modified CDS sequence (AUadapt) from InfluenzaA__ADO12513__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcgaggucgcgccccugcaccucggcaagugcaacaucgccggguggauccugggcaacccggagugcgagucgcuguccaccgccagcuccuggucguacaucguggagaccuccagcuccgacaacgggacgugcuaccccggcgacuucaucgacuacgaggagcuccgggagcagcugucguccgugagcuccuucgagcgcuucgagaucuuccccaagaccucguccuggcccaaccacgacagcaacaagggcgucaccgccgccugcccgcacgccggggcgaaguccuucuacaagaaccugaucuggcucgugaagaagggcaacucguaccccaagcuguccaagagcuacaucaacgacaaggggaaggaggugcugguccucuggggcauccaccaccccucgaccuccgccgaccagcagagccuguaccagaacgccgacgccuacguguucguggggacgucccgguacucgaagaaguucaagcccgagaucgccauccgcccgaagguccgggaccaggagggccgcaugaacuacuacuggacccugguggagcccggcgacaagaucaccuucgaggcgaccgggaaccucguggucccccgguacgccuucgccauggagcgcaacgccggcuccgggaucaucaucagcgacacgcccgugcacgacugcaacacgaccugccagaccccgaagggcgccaucaacaccucccugcccuuccagaacauccaccccaucaccaucggcaagugccccaaguacgucaagucgaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagucgacccagaacgcgaucgacgagaucaccaacaaggugaacuccgucaucgagaagaugaacacccaguucacggccguggggaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcucgagagcacccgcaucuaccagauccuggcgaucuacuccaccgucgccucgagccuggugcucguggucucccugggcgccaucucguucuggaugugcuccaacgggagccugcagugccggaucugcaucuga

SEQ ID NO: 6344 - RNA, 1701 nt, Artificial Sequence; identical to SEQ ID NO: 116
  derived and/or modified CDS sequence (AUadapt) from InfluenzaA__ADO12523__HA

SEQ ID NO: 6345 - RNA, 1701 nt, Artificial Sequence
  derived and/or modified CDS sequence (AUadapt) from InfluenzaA__ADO12533__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgacccggcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggcgaucuacuccaccgucgccucgagccuggugcucguggucucccugggggccaucucguucuggaugugcuccaacggcagccugcagugccgcaucugcaucuga

SEQ ID NO: 6346 - RNA, 1701 nt, Artificial Sequence; identical to SEQ ID NO: 116
  derived and/or modified CDS sequence (AUadapt) from InfluenzaA__ADO12543__HA

SEQ ID NO: 6347 - RNA, 1701 nt, Artificial Sequence; identical to SEQ ID NO: 116
  derived and/or modified CDS sequence (AUadapt) from InfluenzaA__ADO12553__HA

SEQ ID NO: 6348 - RNA, 1701 nt, Artificial Sequence; identical to SEQ ID NO: 116
  derived and/or modified CDS sequence (AUadapt) from InfluenzaA__ADO12563__HA

SEQ ID NO: 6349 - RNA, 1701 nt, Artificial Sequence; identical to SEQ ID NO: 116
  derived and/or modified CDS sequence (AUadapt) from InfluenzaA__ADO12573__HA

SEQ ID NO: 6350 - RNA, 1701 nt, Artificial Sequence
  derived and/or modified CDS sequence (AUadapt) from InfluenzaA__ADO12593__HA
augaaggccauccuggugguccuccuguacaccuucgccaccgcgaacgccgacacgcugugcaucggcuaccacgccaacaacucgaccgacaucguggacaccgugcucgagaagaacgucaccgugacgcacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacgggaccugcuaccccggcgacuucaucgacuacgaggagcuccgggagcagcugagcuccgugucguccuucgagcgcuucgagaucuuccccaagacgagcuccuggcccaaccacgacucgaacaagggcgucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcaccucccgguacagcaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccggguccggcaucaucaucucggacacccccgugcacgacugcaacacgaccugccagaccccgaagggcgccaucaacaccucccugcccuuccagaacauccaccccaucacgaucgggaagugccccaaguacgucaagagcaccaagcugcggcucgcgaccggccugcgcaacgugccguccauccagucgcgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgacccgcaucuaccagauccuggcgaucuacuccaccgucgccagcucgcuggugcucguggucucccugggggccaucagcuucuggaugugcuccaacggcagccugcagugccggaucugcaucuga

SEQ ID NO: 6351 - RNA, 1701 nt, Artificial Sequence; identical to SEQ ID NO: 116
  derived and/or modified CDS sequence (AUadapt) from InfluenzaA__ADO12603__HA

SEQ ID NO: 6352 - RNA, 1701 nt, Artificial Sequence; identical to SEQ ID NO: 116
  derived and/or modified CDS sequence (AUadapt) from InfluenzaA__ADO12613__HA

SEQ ID NO: 6353 - RNA, 1701 nt, Artificial Sequence; identical to SEQ ID NO: 116
  derived and/or modified CDS sequence (AUadapt) from InfluenzaA__ADO12623__HA

SEQ ID NO: 6354 - RNA, 1701 nt, Artificial Sequence
  derived and/or modified CDS sequence (AUadapt) from InfluenzaA__ADO14349__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaaggggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaagggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacaucccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgagccugguccucguggugucccugggggccaucucguucuggaugugcuccaacggcagccugcagugccggaucugcaucuga

SEQ ID NO: 6355 - RNA, 1701 nt, Artificial Sequence; identical to SEQ ID NO: 5178
  derived and/or modified CDS sequence (AUadapt) from InfluenzaA__ADO14351__HA

SEQ ID NO: 6356 - RNA, 1701 nt, Artificial Sequence
  derived and/or modified CDS sequence (AUadapt) from InfluenzaA__ADO14353__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccgaggcgaaguccuucuacaagaaccugaucuggcucgugaagaagggcaacucguaccccaagcuguccaagagcuacaucaacgacaaggggaaggaggugcugguccucuggggcauccaccaccccucgaccuccgccgaccagcagagccuguaccagaacgccgacgccuacguguucguggggacgucccgguacucgaagaaguucaagcccgagaucgccauccgcccgaagguccgggaccaggagggccgcaugaacuacuacuggacccugguggagcccggcgacaagaucaccuucgaggcgaccgggaaccucguggucccccgguacgccuucgccauggagcgcaacgccggcuccgggaucaucaucagcgacacgcccgugcacgacugcaacacgaccugccagaccccgaagggcgccaucaacaccucccugcccuuccagaacauccaccccaucaccaucggcaagugccccaaguacgucaagucgaccaagcugcggcucgcgaccgggcugcgcaacaucccguccauccagagccggggccuguucggggccaucgccggcuucaucgagggcggguggacgggcaugguggacgggugguacggcuaccaccaccagaacgagcagggguccggcuacgccgccgaccucaagucgacccagaacgcgaucgacgagaucaccaacaaggugaacuccgugaucgagaagaugaacacccaguucacggccgucgggaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucggcaacgggugcuucgaguucuaccacaagugcgacaacacgugcauggagucggucaagaacggcaccuacgacuaccccaaguacuccgaggaggccaagcugaaccgggaggagaucgacggggugaagcucgagagcacccgcaucuaccagauccuggcgaucuacuccaccguggccucgagccugguccucguggugucccugggcgccaucucguucuggaugugcuccaacgggagccugcagugccggaucugcaucuga

SEQ ID NO: 6357 - RNA, 1701 nt, Artificial Sequence
  derived and/or modified CDS sequence (AUadapt) from InfluenzaA__ADO14354__HA
augaaggccauccuggugguccuccuguacaccuucgccaccgcgaacgccgacacgcugugcaugggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 6358 - RNA, 1701 nt, Artificial Sequence
  derived and/or modified CDS sequence (AUadapt) from InfluenzaA__ADO14356__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccggggccaggaggggcgcaugaacuacuacuggacccugguggagcccggcgacaagaucaccuucgaggcgaccgggaaccucguggucccccgguacgccuucgccauggagcgcaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagucgaccaagcugcggcucgcgaccgggcugcgcaacaucccguccauccagagccggggccuguucggggccaucgccggcuucaucgagggcggguggacgggcaugguggacgggugguacggcuaccaccaccagaacgagcagggguccggcuacgccgccgaccucaagucgacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggguuccucgacaucuggaccuacaacgccgagcugcugguccuccuggagaacgagcggacccuggacuaccacgacagcaacgugaagaaccucuacgagaaggugcgcucccagcugaagaacaacgccaaggagaucggcaacgggugcuucgaguucuaccacaagugcgacaacacgugcauggagucggucaagaacggcaccuacgacuaccccgaguacuccgaggaggccaagcugaaccgggaggagaucgacggggugaagcucgagagcacccgcaucuaccagauccuggcgaucuacuccaccguggccucgagccugguccucguggugucccugggcgccaucucguucuggaugugcuccaacggcagccugcagugccggaucugcaucuga

SEQ ID NO: 6359 - RNA, 1701 nt, Artificial Sequence; identical to SEQ ID NO: 5178
  derived and/or modified CDS sequence (AUadapt) from InfluenzaA__ADO14357__HA

SEQ ID NO: 6360 - RNA, 1701 nt, Artificial Sequence
  derived and/or modified CDS sequence (AUadapt) from InfluenzaA__ADO14359__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccacccgcccaccucggccgaccagcagucccuguaccagaacgccgacgccuacguguucgugggcacgucgcgguacuccaagaaguucaagcccgagaucgccauccgccccaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgccggugcacgacugcaacacgaccugccagacccccaagggcgccaucaacaccucgcugcccuuccagaacauccaccccaucaccaucgggaagugcccgaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcucgggguacgccgccgaccucaaguccacccagaacgcgaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 6361 - RNA, 1701 nt, Artificial Sequence
  derived and/or modified CDS sequence (AUadapt) from InfluenzaA__ADO14361__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaagggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacaucccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgagccugguccucguggugucccugggggccaucucguucuggaugugcuccaacggcagccugcagugccggaucugcaucuga

SEQ ID NO: 6362 - RNA, 1701 nt, Artificial Sequence
  derived and/or modified CDS sequence (AUadapt) from InfluenzaA__ADO14362__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaacuccgccgaccagcagagccuguaccagaacgccgacgccuacguguucgugggcaccucccgguacucgaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucacgaucgggaagugccccaaguacgucaagucgaccaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagucgacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 6363 - RNA, 1683 nt, Artificial Sequence
  derived and/or modified CDS sequence (AUadapt) from InfluenzaA__ADO21015__HA
auggagguggucagucugaucaccauccuccugcuggugaccguguccaacgccgacaagaucugcaucggcuaccagucgacgaacuccaccgagaccgucgacacccucacggagaacaacgugcccguggcccacgcgaaggagcugcugcacaccgagcacaacgggaugcucugcgccaccaaccugggccacccgcugauccucgacacgugcaccaucgaggggcugaucuacggcaaccccagcugugaccugcuccucgggggccgcgagugguccuacaucgucgagcggcccucggccgugaacggccugugcuaccccgggaacguggagaaccuggaggagcugcgcucccuguucucguccgccagcuccuaccagcggauccagaucuucccgggcaccaucuggaacgucucguacgggggcaccuccaaggccugcagcgacuccuucuacaagucgaugcgcuggcucacccagaagaauaacgcguaccccauccaggacgcccaguacacgaacaaccgggggaagaacauccuguucauguggggcaucaaccacccgcccaccgacaccacccagacgaaccuguacacccgcaccgacaccacgaccuccguggccaccgaggacaucaaccggaccuucaagccccucaucggcccccgcccccuggugaacgggcagcagggccggaucgacuacuacuggaguguccugaagcccgggcagacgcuccgcgugcgguccaacggcaaccugaucgccccgugguacggccacauccugagcggggagucgcacggccgcauccucaagaccgaccugaacuccgggaacugcgugguccagugccagaccgagcggggcgggcugaacaccacgcuccccuuccacaacgugucgaaguacgcguucggcaacugccccaaguacgugggcgucaagucccugaagcuggccguggggcuccgcaaugugcccgcccggagcucccgcggccuguucggggccaucgccggcuucaucgagggcggguggucgggccuggucgcggggugguacggcuuccagcacuccaacgaccagggggugggcauggccgccgaccgggacagcacccagaaggccaucgacaagaucaccuccaaggugaacaacaucgucgacaagaugaacaagcaguacgagaucaucgaccacgaguucagugagguggagacccgccucaacaugaucaacaacaagaucgacgaccagauccaggacaucugggccuacaacgcggagcugcugguccuccuggagaaccagaagacgcuggacgagcacgacgccaacgugaacaaccucuacaacaaggugaagcgggcccugggguccaacgccgucgaggacggcaagggcugcuucgagcuguaccauaagugcgacgaccagugcauggagaccauccgcaacgggaccuacaaccggcgcaaguacaaggaggagucgcgccucgagcggcagaagaucgagggcgugaagcuggaguccgaggggaccuacaagauccugacgaucuacagcaccguggccuccucgcucgucaucgcgaugggcuucgccgccuuccuguucugggccauguccaacggcagcugccgcugcaacaucugcaucuga

SEQ ID NO: 6364 - RNA, 1683 nt, Artificial Sequence
  derived and/or modified CDS sequence (AUadapt) from InfluenzaA__ADO21026__HA
auggagguggucagucugaucaccauccuccugcuggugaccguguccaacgccgacaagaucugcaucggcuaccagucgacgaacuccaccgagaccgucgacacccucacggagaacaacgugcccguggcccacgcgaaggagcugcugcacaccgagcacaacgggaugcucugcgccaccaaccugggccacccgcugauccucgacacgugcaccaucgaggggcugaucuacggcaaccccagcugugaccugcuccucgggggccgcgagugguccuacaucgucgagcggcccucggccgugaacggccugugcuaccccgggaacguggagaaccuggaggagcugcgcucccuguucucguccgccagcuccuaccagcggauccagaucuucccgggcaccaucuggaacgucucguacgggggcaccuccaaggccugcagcgacuccuucuacaagucgaugcgcuggcucacccagaagaauaacgcguaccccauccaggacgcccaguacacgaacaaccgggggaagaacauccuguucauguggggcaucaaccacccgcccaccgacaccacccagacgaaccuguacacccgcaccgacaccacgaccuccguggccaccgaggacaucaaccggaccuucaacccccucaucggcccccgcccccuggugaacgggcagcagggccggaucgacuacuacuggaguguccugaagcccgggcagacgcuccgcgugcgguccaacggcaaccugaucgccccgugguacggccacauccugagcggggagucgcacggccgcauccucaagaccgaccugaacuccgggaacugcgugguccagugccagaccgagcggggcgggcugaacaccacgcuccccuuccacaacgugucgaaguacgcguucggcaacugccccaaguaugugggcgucaagucccugaagcuggccguggggcuccgcaacgugcccgcccggagcucccgcggccuguucggggccaucgccggcuucaucgagggcggguggucgggccuggucgcggggugguacggcuuccagcacuccaacgaccagggggugggcauggccgccgaccgggacagcacccagaaggccaucgacaagaucaccuccaaggugaacaacaucgucgacaagaugaacaagcaguacgagaucaucgaccacgaguucagugagguggagacccgccucaacaucaucaacaacaagaucgacgaccagauccaggacaucugggccuacaacgcggagcugcugguccuccuggagaaccagaagacgcuggacgagcacgacgccaacgugaacaaccucuacaacaaggugaagcgggcccugggguccaacgccgucgaggacggcaagggcugcuucgagcuguaccauaagugcgacgaccagugcauggagaccauccgcaacgggaccuacaaccggcgcaaguacaaggaggagucgcgccucgagcggcagaagaucgagggcgugaagcuggaguccgaggggaccuacaagauccugacgaucuacagcaccguggccuccucgcucgucaucgcgaugggcuucgccgccuuccuguucugggccauguccaacggcagcugccgcugcaacaucugcaucuga

SEQ ID NO: 6365 - RNA, 1683 nt, Artificial Sequence
  derived and/or modified CDS sequence (AUadapt) from InfluenzaA__ADO21037__HA
auggagguggucagucugaucaccauccuccugcuggugaccguguccaacgccgacaagaucugcaucggcuaccagucgacgaacuccaccgagaccgucgacacccucacggagaacaacgugcccguggcccacgcgaaggagcugcugcacaccgagcacaacgggaugcucugcgccaccaaccugggccacccgcugauccucgacacgugcaccaucgaggggcugaucuacggcaaccccagcugcgaccugcuccucgggggccgcgagugguccuacaucgucgagcggcccucggccgugaauggccugugcuaccccgggaacguggagaaccuggaggagcugcgcucccuguucucguccgccagcuccuaccagcggauccagaucuucccgggcaccaucuggaacgucucguacgggggcaccuccaaggccugcucggacuccuucuacaagagcaugcgcuggcucacccagaagaacaacgcguaccccauccaggacgcccaguacacgaacaaccgggggaagaauauccuguucauguggggcaucaaccacccgcccaccgacaccacccagacgaaccuguacacccgcaccgacaccacgaccuccguggccaccgaggacaucaaccggaccuucaagcccuacaucggcccccgcccccucgugaacgggcagcagggccggaucgacuacuacuggucgguccugaagcccgggcagacgcugcgcgugcgguccaacggcaaccucaucgccccgugguacggccacauccugucgggggagagccacggccgcauccugaagaccgaccucaacuccgggaacugugugguccagugccagaccgagcggggcgggcugaacaccacgcugcccuuccacaacgugucgaaguacgcguucggcaacugccccaaguacgugggcgucaagucccucaagcuggccguggggcugcgcaacgugcccgcccggucgucccgcggccucuucggggccaucgccggcuucaucgagggcggguggagcggccuggucgcggggugguacggcuuccagcacuccaacgaccagggggugggcauggccgccgaccgggaccugacccagaaggccaucgacaagaucaccucgaaggugaauaacaucgucgacaagaugaacaagcaguacgagaucaucgaccacgaguucuccgagguggagacccgccucaacaugaucaacaacaagaucgacgaccagauccaggacaucugggccuacaacgcggagcugcugguccuccuggagaaccagaagacgcuggacgagcacgacgccaacgugaacaaccucuacaacaaggugaagcgggcccuggggucgaaugccgucgaggacggcaagggcugcuucgagcuguaccacaagugcgacgaccagugcauggagaccauccgcaacgggaccuacaaccggcgcaaguacaaggaggagucccgccucgagcggcagaagaucgagggcgugaagcuggagagcgaggggaccuacaagauccugacgaucuacuccaccguggccucgucccucgucaucgcgaugggcuucgccgccuuccuguucugggccaugagcaacggcuccugccgcugcaacaucugcaucuga

SEQ ID NO: 6366 - RNA, 1683 nt, Artificial Sequence
  derived and/or modified CDS sequence (AUadapt) from InfluenzaA__ADO21048__HA
auggagguggucagucugaucaccauccuccugcuggugaccguguccaacgccgacaagaucugcaucggcuaccagucgacgaacuccaccgagaccgucgacacccucacggagaacaacgugcccguggcccacgcgaaggagcugcugcacaccgagcacaacgggaugcucugcgccaccaaccugggccacccgcugauccucgacacgugcaccaucgaggggcugaucuacggcaaccccagcugugaccugcuccucgggggccgcgagugguccuacaucgucgagcggcccucggccgugaacggccugugcuaccccgggaacguggagaaccuggaggagcugcgcucccuguucucguccgccagcuccuaccagcggauccagaucuucccgggcaccaucuggaacgucucguacgggggcaccuccaaggccugcagcgacuccuucuacaagucgaugcgcuggcucacccagaagaauaacgcguaccccauccaggacgcccaguacacgaacaaccgggggaagaacauccacuucauguggggcaucaaccacccgcccaccgacaccacccagacgaaccuguacacccgcaccgacaccacgaccuccguggccaccgaggacaucaaccggaccuucaagccccugaucggcccccgcccccucgugaacgggcagcagggccggaucgacuacuauuggucgguccugaagcccgggcagacgcugcgcgugcgguccaacggcaaccucaucgccccgugguacggccacauccugagcggggagucgcacggccgcauccugaagaccgaccucaacuccgggaacugcgugguccagugccagaccgagcggggcgggcugaacaccacgcugcccuuccacaacgugucgaaguacgcguucggcaacugccccaaguaugugggcgucaagucccucaagcuggccguggggcugcgcaacgugcccgcccggagcucccgcggccucuucggggccaucgccggcuucaucgagggcggguggucgggccuggucgcggggugguacggcuuccagcacuccaacgaccagggggugggcauggccgccgaccgggugagcacccagaaggccaucgacaagaucaccuccaaggucaacaacaucguggacaagaugaacaagcaguacgagaucaucgaccacgaguucagugaggucgagacccgccugaacaugaucaacaacaagaucgacgaccagauccaggacaucugggccuacaacgcggagcuccuggugcugcucgagaaccagaagacgcuggacgagcacgacgccaacgugaacaaccuguacaacaaggucaagcgggcccucggguccaacgccguggaggacggcaagggcugcuucgagcuguaccauaagugcgacgaccagugcauggagaccauccgcaacgggaccuacaaccggcgcaaguacaaggaggagucgcgccuggagcggcagaagaucgagggcgugaagcucgaguccgaggggaccuacaagauccugacgaucuacagcaccgucgccuccucgcuggugaucgcgaugggcuucgccgccuuccucuucugggccauguccaacggcagcugccgcugcaacaucugcaucuga

SEQ ID NO: 6367 - RNA, 1701 nt, Artificial Sequence
  derived and/or modified CDS sequence (AUadapt) from InfluenzaA__ADO25092__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggucaccgccgccugcccgcacgccggcgcgaaguccuucuacaagaaccugaucuggcucgugaagaaggggaacagcuaccccaagcuguccaacucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgcccacgacugcaacacgaccugccagaccccgaagggcgcgaucaacaccucccugcccuuccagaacauccaccccaucaccaucgggaagugccccaaguacgucaagagcaccaagcugcggcucgccaccggccugcgcaacgugccguccauccagucgcgggggcuguucggcgccaucgccggguucaucgagggcggcuggacggggaugguggacggcugguacggguaccaccaccagaacgagcagggcuccggguacgccgcggaccucaagucgacccagaacgccaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggcgaagcugaaccgggaggagaucgacggcgugaagcucgagagcacccgcaucuaccagauccuggccaucuacuccaccguggccucgagccugguccucguggugucccugggggccaucucguucuggaugugcuccaacggcagccugcagugccggaucugcaucuga

SEQ ID NO: 6368 - RNA, 1701 nt, Artificial Sequence; identical to SEQ ID NO: 4786
  derived and/or modified CDS sequence (AUadapt) from InfluenzaA__ADO25112__HA

SEQ ID NO: 6369 - RNA, 1701 nt, Artificial Sequence; identical to SEQ ID NO: 4786
  derived and/or modified CDS sequence (AUadapt) from InfluenzaA__ADO25122__HA

SEQ ID NO: 6370 - RNA, 1701 nt, Artificial Sequence
  derived and/or modified CDS sequence (AUadapt) from InfluenzaA__ADO25132__HA
augaacgccauccuggugguccuccuguacaccuucgccaccgcgaacgccgacacgcugugcaucggcuaccacgccaacaacucgaccgacaccguggacacccuccuggagaagaacgugacggucacccacuccgugaaccugcucgaggacaagcacaacgggaagcugugcaagcugcgcggcguggcgccccuccaccuggggaagugcaacaucgccggcuggauccuggggaacccggagugcgagucgcucuccaccgccagcuccuggucguacaucgucgagaccuccagcuccgacaacggcacgugcuaccccggcgacuucaucgacuacgaggagcugcgggagcagcugucguccgugagcuccuucgagcgcuucgagaucuuccccaagaccucguccuggcccaaccacgacagcaacaagggggugaccgccgccugcccgcacgccggcgcgaaguccuucuacaagaaccucaucuggcuggucaagaaggggaacucguaccccaagcuguccaagagcuacaucaacgacaagggcaaggaggugcucgugcugugggggauccaccaccccucgaccuccgccgaccagcagagccuguaccagaacgccgacgccuacgucuucgugggcacgucccgguacucgaagaaguucaagcccgagaucgccauccgcccgaaggugcgggaccaggagggccgcaugaacuacuacuggacccucgucgagcccggggacaagaucaccuucgaggcgaccggcaaccugguggugccccgguacgccuucgccauggagcgcaacgccggguccgacaucaucaucagcgacacgcccguccacgacugcaacacgaccugccagaccccgaagggcgccaucaacaccucccugcccuuccagaacauccaccccaucaccaucggcaagugccccaaguacgucaagucgaccaagcuccggcuggcgaccgggcugcgcaacgugccguccauccagagccggggccucuucggggccaucgccggcuucaucgagggcggguggacgggcaugguggacgggugguacggcuaccaccaccagaacgagcagggguccggcuacgccgccgaccucaagucgacccagaacgcgaucgacgagaucaccaacaagaucaacuccgugaucgagaagaugaacacccaguucacggccguggggaaggaguucaaccaccuggagaagcgcaucgagaaccugaacaagaaggucgacgacggcuuccuggacaucuggaccuacaacgccgagcugcucgugcugcuggagaacgagcggacccucgacuaccacgacagcaacgucaagaaccuguacgagaaggugcgcucccagcugaagaacaacgccaaggagaucggcaacgggugcuucgaguucuaccacaagugcgacaacacgugcauggagucggugaagaacggcaccuacgacuaccccaaguacuccgaggaggccaagcucaaccgggaggagaucgacggggucaagcuggagagcacccgcaucuaccagauccuggcgaucuacuccaccguggccucgagccucgugcuggucgugucccugggcgccaucucguucuggaugugcuccaacgggagccuccagugccggaucugcaucuga

SEQ ID NO: 6371 - RNA, 1701 nt, Artificial Sequence; identical to SEQ ID NO: 4527
  derived and/or modified CDS sequence (AUadapt) from InfluenzaA__ADO25142__HA

SEQ ID NO: 6372 - RNA, 1701 nt, Artificial Sequence
  derived and/or modified CDS sequence (AUadapt) from InfluenzaA__ADO25152__HA
augaaggccauccuggugguccuccuguacaccuucgccgcggccaacgccgacacccugugcaucggcuaccacgccaacaacucgacggacaccguggacaccgugcucgagaagaacgucaccgugacgcacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacgggaccugcuaccccggcgacuucaucaacuacgaggagcuccgggagcagcugagcuccgugucgcuguucgagcgcuucgagaucuuccccaagacguccagcuggcccaaccacgacuccaacaagggggucaccgccgccugcccgcacgcgggcgccaagucguucuacaagaaccucaucuggcuggugaagaaggggaacuccuaccccaagcugagcaaguccuacaucaacgacaagggcaaggaggugcucguccugugggggauccaccaccccucgaccagcgccgaccagcagucccuguaccagaacgccgacgccuacguguucgugggcaccucgcgguacuccaagaaguucaagcccgagaucgcgauccgcccgaagguccgggaccaggagggccgcaugaacuacuacuggacgcucguggagcccggggacaagaucaccuucgaggccaccggcaaccugguggucccccgguacgccuucgccauggagcgcaacgccgggagcggcaucaucaucuccgacacccccgugcacgacugcaacacgaccugccagaccccgaagggcgcgaucaacaccucgcugcccuuccagaacauccaccccaucacgaucgggaagugccccaaguacgugaaguccaccaagcuccggcuggccaccggccugcgcaacgucccgagcauccagucccggggccucuucggcgccaucgccggguucaucgagggcggcuggaccgggaugguggacggcugguacggguaccaccaccagaacgagcagggcucgggguacgccgcggaccugaaguccacgcagaacgccaucgacaagaucaccaacaaggugaacagcgucaucgagaagaugaacacccaguucaccgccgugggcaaggaguucaaccaccuggagaagcgcaucgagaaccucaacaagaaggucgacgacggcuuccuggacaucuggacguacaacgccgagcugcucgugcugcuggagaacgagcggacccucgacuaccacgacuccaacgugaagaaccuguacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggcgaagcucaaccgggaggagaucgacggcgugaagcuggaguccacccgcaucuaccagauccuggccaucuacucgaccgucgccuccagccucgugcugguggucucgcugggggccaucuccuucuggaugugcagcaacggcucccuccagugccggaucugcaucuga

SEQ ID NO: 6373 - RNA, 1701 nt, Artificial Sequence; identical to SEQ ID NO: 4466
  derived and/or modified CDS sequence (AUadapt) from InfluenzaA__ADO25162__HA

SEQ ID NO: 6374 - RNA, 1701 nt, Artificial Sequence; identical to SEQ ID NO: 4466
  derived and/or modified CDS sequence (AUadapt) from InfluenzaA__ADO25172__HA

SEQ ID NO: 6375 - RNA, 1701 nt, Artificial Sequence; identical to SEQ ID NO: 4466
  derived and/or modified CDS sequence (AUadapt) from InfluenzaA__ADO25182__HA

SEQ ID NO: 6376 - RNA, 1701 nt, Artificial Sequence; identical to SEQ ID NO: 116
  derived and/or modified CDS sequence (AUadapt) from InfluenzaA__ADO25192__HA

SEQ ID NO: 6377 - RNA, 1701 nt, Artificial Sequence; identical to SEQ ID NO: 116
  derived and/or modified CDS sequence (AUadapt) from InfluenzaA__ADO25202__HA

SEQ ID NO: 6378 - RNA, 1701 nt, Artificial Sequence
  derived and/or modified CDS sequence (AUadapt) from InfluenzaA__ADO25212__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagcggaaggaggugcugguccucuggggcauccaccaccccagcaccuccgccgaccagcagucgcuguaccagaacgccgacuccuacguguucguggggacgagccgcuacuccaagaaguucaagcccgagaucgccauccggccgaagguccgcgaccaggagggccggaugaacuacuacuggacccugguggagcccggcgacaagaucaccuucgaggccaccgggaaccucguggucccccgcuacgcguucgccauggagcggaacgccggcucggggaucaucaucuccgacacgcccgugcacgacugcaacacgaccugccagaccccggagggcgccaucaacaccagccugcccuuccagaacauccaccccaucaccaucggcaagugccccaaguacgugaaguccaccaagcugcgccucgccaccgggcugcggaacgucccgucgauccagucccgcggccuguucggggcgaucgccggcuucaucgagggcggguggacgggcaugguggacgggugguacggcuaccaccaccagaacgagcaggggagcggcuacgccgccgaccucaaguccacccagaacgccaucgacgagaucaccaacaaggugaacucggucaucgagaagaugaacacccaguucacggcgguggggaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaacgugaagaaccucuacgagaagguccggagccagcugaagaacaacgccaaggagaucggcaacgggugcuucgaguucuaccacaagugcgacaacacgugcauggaguccgugaagaacggcaccuacgacuaccccaaguacucggaggaggccaagcugaaccgcgaggagaucgacggggugaagcucgaguccacccggaucuaccagauccuggccaucuacagcaccgucgcgucgucccuggugcucguggucagccugggcgccaucuccuucuggaugugcagcaacgggucccugcagugccgcaucugcaucuga

SEQ ID NO: 6379 - RNA, 1701 nt, Artificial Sequence
  derived and/or modified CDS sequence (AUadapt) from InfluenzaA__ADO25222__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcugaacaaguccuacaucaacgacaagggcaaggaggugcugguccucugggggauccaccaccccagcaccucggccgaccagcagucccuguaccagaacgccgacgccuacguguucgugggcacgucgcgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccucgcugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcucgggguacgccgccgaccucaaguccacccagaacgcgaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 6380 - RNA, 1701 nt, Artificial Sequence; identical to SEQ ID NO: 4527
  derived and/or modified CDS sequence (AUadapt) from InfluenzaA__ADO25232__HA

SEQ ID NO: 6381 - RNA, 1701 nt, Artificial Sequence; identical to SEQ ID NO: 4466
  derived and/or modified CDS sequence (AUadapt) from InfluenzaA__ADO25242__HA

SEQ ID NO: 6382 - RNA, 1701 nt, Artificial Sequence; identical to SEQ ID NO: 4544
  derived and/or modified CDS sequence (AUadapt) from InfluenzaA__ADO25252__HA

SEQ ID NO: 6383 - RNA, 1701 nt, Artificial Sequence; identical to SEQ ID NO: 4786
  derived and/or modified CDS sequence (AUadapt) from InfluenzaA__ADO25262__HA

SEQ ID NO: 6384 - RNA, 1701 nt, Artificial Sequence
  derived and/or modified CDS sequence (AUadapt) from InfluenzaA__ADO25272__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagauguuccccaagaccagcuccuggcccaaccacgacucgaacaagggggucaccgccgccugcccgcacgccggcgugaaguccuucuacaagaaccugaucuggcucgugaagaaggggaacagcuaccccaagcuguccaagucguacaucaacgacaagggcaaggagguccuggugcucugggggauccaccaccccagcaccuccgcggaccagcagucgcuguaccagaacgccgacgccuacguguucgucggcacgucccgguacagcaagaaguucaagcccgagaucgccauccgcccgaaggugcgggaccaggagggccgcaugaacuacuacuggacccugguggagcccggggacaagaucaccuucgaggccaccggcaaccucgucgugccccgguacgcguucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgccaccggccugcgcaacgugccguccauccagucgcgggggcuguucggcgcgaucgccggguucaucgagggcggcuggacggggaugguggacggcugguacggguaccaccaccagaacgagcagggcuccggguacgccgccgaccucaagagcacccagaacgccaucgacgagaucaccaacaaggucaacuccgugaucgagaagaugaacacccaguucacggcggucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacucgaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagucgacccgcaucuaccagauccuggccaucuacuccaccguggcgagcucgcuggugcucgucgugucccugggggccaucagcuucuggaugugcuccaacggcagccugcagugccggaucugcaucuga

SEQ ID NO: 6385 - RNA, 1701 nt, Artificial Sequence; identical to SEQ ID NO: 4527
  derived and/or modified CDS sequence (AUadapt) from InfluenzaA__ADO25282__HA

SEQ ID NO: 6386 - RNA, 1698 nt, Artificial Sequence; identical to SEQ ID NO: 2733
  derived and/or modified CDS sequence (AUadapt) from InfluenzaA__ADO27622__HA

SEQ ID NO: 6387 - RNA, 1701 nt, Artificial Sequence; identical to SEQ ID NO: 116
  derived and/or modified CDS sequence (AUadapt) from InfluenzaA__ADO29887__HA

SEQ ID NO: 6388 - RNA, 1701 nt, Artificial Sequence
  derived and/or modified CDS sequence (AUadapt) from InfluenzaA__ADO29888__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugccgccugcggggcgucgcgccccugcaccucgggaagugcaacaucgccggcuggauccuggggaacccggagugcgagucgcuguccaccgcgagcuccuggucguacaucguggagaccuccagcuccgacaacggcacgugcuaccccggcgacuucaucgacuacgaggagcuccgcgagcagcugucguccgugagcuccuucgagcgguucgagaucuuccccaagaccucguccuggcccaaccacgacccgaacaagggggucaccgccgccugcccccacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacguguucgugggcacgucgcgcuacuccaagaaguucaagccggagaucgccauccggcccaagguccgcgaccaggagggccggaugaacuacuacuggacccugguggagcccggggacaagaucaccuucgaggcgaccggcaaccucguggucccccgcuacgccuucgccauggagcggaacgccgggagcggcaucaucaucuccgacacgccggugcacgacugcaacacgaccugccagacccccaagggcgccaucaacaccucgcugcccuuccagaacauccaccccaucaccaucgggaagugcccgaaguacgugaaguccaccaagcugcgccucgcgaccggccugcggaacguccccagcauccagucccgcgggcuguucggcgccaucgccggguucaucgagggcggcuggacggggaugguggacggcugguacggguaccaccaccagaacgagcagggcucgggguacgccgccgaccucaaguccacccagaacgcgaucgacgagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaacgugaagaaccucuacgagaagguccggucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgugaagcucgaguccacccggaucuaccagauccuggcgaucuacucgaccgucgccuccagccuggugcucguggucucgcugggggccaucuccuucuggaugugcagcaacggcucccugcagugccgcaucugcaucuga

SEQ ID NO: 6389 - RNA, 1701 nt, Artificial Sequence
  derived and/or modified CDS sequence (AUadapt) from InfluenzaA__ADO29889__HA
augaaggccauccuggugguccuccuguacaccuucgccaccgcgaacgccgacauccugugcaucggcuaccacgccaacaacucgacggacaccguggacaccgugcucgagaagaacgucaccgugacgcacuccgugaaccugcuggaggacaagcacaacgggaagcucugcaagcugcgcggcgucgcgccccugcaccucgggaagugcaacaucgccggcuggauccuggggaacccggagugcgagagcuucuccaccucguccagcugguccuacaucguggagaccagcuccucggacaacgggaccugcuaccccggcgacuucaucgacuacgaggagcugcgggagcagcucuccagcguguccucguucgagcgcuucgagaucuuccccaagacguccagcuggcccaaccacgacuccaacaagggcgucaccgccgccugcccgcacgccggcgccaagagcuucuacaagaaccugaucuggcuggugaagaaggggaacuccuaccccaagcucucgaagagcuacaucaacgacaagggcaaggaggugcugguccugugggggauccaccaccccuccaccucggcggaccagcagucccucuaccagaacgccgacgccuacguguucgugggcaccagccgguacuccaagaaguucaagcccgagaucgccauccgcccgaagguccgggaccaggagggccgcaugaacuacuacuggacgcugguggagcccggggacaagaucaccuucgaggccaccggcaaccugguggucccccgguacgcguucgccauggagcgcaacgccgggagcggcaucaucaucuccgacacccccgugcacgacugcaacacgaccugccagaccccgaagggcgccaucaacaccucgcuccccuuccagaacauccaccccaucacgaucgggaagugccccaaguacgugaaguccaccaagcugcggcuggccaccggccuccgcaacgucccgagcauccagucccgggggcuguucggcgcgaucgccggguucaucgagggcggcuggaccgggaugguggacggcugguacggguaccaccaccagaacgagcagggcucgggguacgccgccgaccugaaguccacgcagaacgccaucgacgagaucaccaacaaggugaacagcgucaucgagaagaugaacacccaguucaccgcggugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcuggaguccacccgcaucuaccagauccucgccaucuacagcaccgucgcgucgucccuggugcugguggucagccucggggccaucuccuucuggaugugcagcaacggcucccugcagugccggaucugcaucuga

SEQ ID NO: 6390 - RNA, 1701 nt, Artificial Sequence
  derived and/or modified CDS sequence (AUadapt) from InfluenzaA__ADO29890__HA
augaaggccauccuggugguccuccuguacaccuucgccaccgcgaaggccgacacgcugugcaucggcuaccacgccaacaacucggccgacaccguggacaccgugcucgagaagaacgucaccgugacgcacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacgggaccugcuaccccggcgacuucaucgacuacgaggagcuccgggagcagcugagcuccgugucguccuucgagcgcuucgagaucuuccccaagacgagcuccuggcccaaccacgacccgaacaagggcgucaccgccgccugcccccacgcgggcgccaagucguucuacaagaaccugaucuggcucgugaagaaggggaacuccuaccccaagcugagcaaguccuacaucaacgacaagggcaaggaggugcugguccucugggggauccaccaccccucgaccagcguggaccagcagucccuguaccagaacgccgacgccuacguguucgucggcaccucgcgguacuccaagaaguucaagccggagaucgccauccgccccaaggugcgggaccaggagggccgcaugaacuacuacuggacgcugguggagcccggggacaagaucaccuucgaggcgaccggcaaccucgucgugccccgguacgccuucgccauggagcgcaacgccgggagcggcaucaucaucuccgacaccccggugcacgacugcaacacgaccugccagacccccaagggcgccaucaacaccucgcugcccuuccagaacauccaccccaucacgaucgggaagugcccgaaguacgucaaguccaccaagcugcggcucgcgaccggccugcgcaacgugcccagcauccagucccgggggcuguucggcgccaucgccggguucaucgagggcggcuggaccgggaugguggacggcugguacggguaccaccaccagaacgagcagggcucgggguacgccgccgaccucaaguccacgcagaacgcgaucgacgagaucaccaacaaggucaacagcgugaucgagaagaugaacacccaguucaccgccgucggcaaggaguucaaccaccuggagaagcgcaucgagaaccugaacaagaagguggacgacggcuuccucgacaucuggacguacaacgccgagcugcuggugcuccuggagaacgagcggacccuggacuaccacgacuccaacgucaagaaccucuacgagaaggugcgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgucaagcucgaguccacccgcaucuaccagauccuggcgaucuacucgaccguggccuccagccuggugcucgucgugucgcugggggccaucuccuucuggaugugcagcaacggcucccugcagugccggaucugcaucuga

SEQ ID NO: 6391 - RNA, 1701 nt, Artificial Sequence
  derived and/or modified CDS sequence (AUadapt) from InfluenzaA__ADO29891__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaccaccuucgaggcgacgggcaaccucguggucccccgguacgccuucgccauggagcgcaacgccggguccggcaucaucaucucggacacccccgugcacgacugcaacacgaccugccagaccccgaagggcgccaucaacaccucccugcccuuccagaacauccaccccaucaccaucgggaagugccccaaguacgucaagagcaccaagcugcggcucgcgacgggccugcgcaacgugccguccauccagucgcgggggcuguucggcgccaucgccggguucaucgagggcggcuggaccgggaugguggacggcugguacggguaccaccaccagaacgagcagggcuccggguacgccgccgaccucaagucgacccagaacgcgaucgacaagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcucagcgagaacgagcggacccuggacuaccacgacuccaacgugaagaaccuguacgagaagguccgcucgcagcucaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcuggaguccacccgcaucuaccagauccucgcgaucuacucgaccgucgccagcucccuggugcugguggucucgcucggggccaucuccuucuggaugugcagcaacggcucccugcagugccggaucugcaucuga

SEQ ID NO: 6392 - RNA, 1701 nt, Artificial Sequence
  derived and/or modified CDS sequence (AUadapt) from InfluenzaA__ADO29892__HA
augaaggccauccuggugguccuccuguacaccuucgccaccgcgaaggccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggccggauccuggggaacccggagugcgagucgcuguccaccgcgagcuccuggucguacaucguggagaccuccagcuccgacaacggcacgugcuaccccggcgacuucaucgacuacgaggagcuccgcgagcagcugucguccgugagcuccuucgagcgguucgagaucuuccccaagaccucguccuggcccaaccacgacccgaacaagggggucaccgccgccugcccccacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucgguggaccagcagucccuguaccagaacgccgacgccuacguguucgucggcacgucgcgcuacuccaagaaguucaagccggagaucgccauccggcccaaggugcgcgaccaggagggccggaugaacuacuacuggacccugguggagcccggggacaagaucaccuucgaggccaccggcaaccucgucgugccccgcuacgcguucgccauggagcggaacgccgggagcggcaucaucaucuccgacacgccggugcacgacugcaacacgaccugccagacccccaagggcgccaucaacaccucgcugcccuuccagaacauccaccccaucaccaucgggaagugcccgaaguacgucaaguccaccaagcugcgccucgccaccggccugcggaacgugcccagcauccagucccgcgggcuguucggcgcgaucgccggguucaucgagggcggcuggacggggaugguggacggcugguacggguaccaccaccagaacgagcagggcucgggguacgccgccgaccucaaguccacccagaacgccaucgacgagaucaccaacaaggucaacagcgugaucgagaagaugaacacccaguucacggcggucggcaaggaguucaaccaccuggagaagcggaucgagaaccugaacaagaagguggacgacggcuuccucgacaucuggaccuacaacgccgagcugcuggugcuccuggagaacgagcgcacccuggacuaccacgacuccaacgucaagaaccucuacgagaaggugcggucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgucaagcucgaguccacccggaucuaccagauccuggccaucuacucgaccguggcguccagccuggugcucgucgugucgcugggggccaucuccuucuggaugugcagcaacggcucccugcagugccgcaucugcaucuga

SEQ ID NO: 6393 - RNA, 1701 nt, Artificial Sequence; identical to SEQ ID NO: 3712
  derived and/or modified CDS sequence (AUadapt) from InfluenzaA__ADO29893__HA

SEQ ID NO: 6394 - RNA, 1701 nt, Artificial Sequence
  derived and/or modified CDS sequence (AUadapt) from InfluenzaA__ADO29894__HA
augaaggccauccuggugguccuccuguacaccuucgccaccgcgaacgccgacacgcugugcaucggcuaccacgccaacaacucgaccgacaccguggacaccgugcucgagaugaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagcuucuccaccucguccagcugguccuacaucguggagaccagcuccucggacaacggcacgugcuaccccggcgacuucaucgacuacgaggagcugcgggagcagcucuccagcguguccucguucgagcgcuucgagaucuuccccaagaccuccagcuggcccaaccacgacuccaacaagggggucaccgccgccugcccgcacgccggcgccaagagcuucuacaagaaccugaucuggcuggugaagaagggguccucguaccccaagcucagcaaguccuacaucaacgacaagggcaaggaggugcugguccugugggggauccaccaccccagcaccuccgcggaccagcagucgcucuaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggccaccggcaaccugguggucccccgguacgcguucgccauggagcgcaacgccggguccggcaucaucaucucggacacgcccgugcacgacugcaacacgaccugccagaccccgaagggcgccaucaacaccucccuccccuuccagaacauccaccccaucaccaucgggaagugccccaaguacgucaagagcaccaagcugcggcuggccaccggccuccgcaacgugccguccauccagagccgggggcuguucggcgcgaucgccggguucaucgagggcggcuggacggggaugguggacggcugguacggguaccaccaccagaacgagcagggcuccggguacgccgccgaccucaagucgacccagaacgccaucgacgagaucaccaacaaggugaacuccgucaucgagaagaugaacacccaguucacggcggugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcuggagagcacccgcaucuaccagauccucgccaucuacagcaccgucgcguccucgcuggugcugguggucucccucggggccaucagcuucuggaugugcuccaacggcagccugcagugccggaucugcaucuga

SEQ ID NO: 6395 - RNA, 1701 nt, Artificial Sequence
  derived and/or modified CDS sequence (AUadapt) from InfluenzaA__ADO29895__HA
augaaggccauccugguggcccuccuguacaccuucgcgaccgccaacgccgacacgcugugcaucggcuaccacgccaacaacucgaccgacaccgucgacaccgugcucgagaagaacgugacggucacccacuccgugaaccugcuggaggacaagcacaacgggaagcucugcaagcugcgcggcguggcgccccugcaccucgggaagugcaacaucgcgggcuggauccuggggaacccggagugcgagucguucuccaccagcuccucgugguccuacaucgucgagaccagcuccucggacaacggcacgugcuaccccggcgacuucaucgacuacgaggagcugcgggagcagcucuccagcguguccucguucgagcgcuucgagaucuuccccaagaccuccagcuggcccaaccacgacuccaacaagggggugaccgccgccugcccgcacgccggcgccaagucguucuacaagaaccugaucuggcuggucaagaagggguccagcuaccccaagcucucgaaguccuacaucaacgacaagggcaaggaggugcuggugcugugggggauccaccaccccagcaccuccgccgaccagcagucgcucuaccagaacgccgacgccuacgucuucgugggcacgucccgguacagcaagaaguucaagcccgagaucgccauccgcccgaaggugcgggaccaggagggccgcaugaacuacuacuggacccuggucgagcccggggacaagaucaccuucgaggcgaccggcaaccugguggugccccgguacgccuucgccauggagcgcaacgccggguccggcaucaucaucucggacacgcccguccacgacugcaacacgaccugccagaccccgaagggcgccaucaacaccucccuccccuuccagaacauccaccccaucaccaucgggaagugccccaaguacgugaagggcaccaagcugcggcuggcgaccgggcuccgcaacgugccgagcauccagucccggggccuguucggggccaucgccggcuucaucgagggcggguggacgggcauggucgacgggugguacggcuaccaccaccagaacgagcaggggucgggcuacgccgccgaccugaaguccacccagaacgcgaucgacgagaucaccaacaaggugaacagcgugaucgagaagaugaacacccaguucacggccgucggcaaggaguucaaccaccucgagaagcgcaucgagaaccugaacaagaagguggacgacggguuccuggacaucuggaccuacaacgccgagcuccugguccugcucgagaacgagcggacccuggacuaccacgacuccaacgugaagaaccuguacgagaaggugcgcucgcagcucaagaacaacgccaaggagaucggcaacgggugcuucgaguucuaccacaagugcgacaacacgugcauggagcgggucaagaacggcaccuacgacuaccccaaguacuccgaggaggccaagcugaaccgcgaggagaucgacggggugaagcuggagagcacccggaucuaccagauccucgcgaucuacuccaccguggccucgagccugguccugguggugucccucggcgccaucucguucuggaugugcuccaacggcagccugcagugccgcaucugcaucuga

SEQ ID NO: 6396 - RNA, 1701 nt, Artificial Sequence
  derived and/or modified CDS sequence (AUadapt) from InfluenzaA__ADO29897__HA
augaaggccauccuggugguccuccuguacaccuucgccaccgcgaacgccgacauccugugcaucggcuaccacgccaacaacucgacggacaccguggacaccgugcucgagaagaacgucaccgugacgcacuccgugaaccugcuggaggacaagcacaacgggaagcucugcaagcugcgcggcgucgcgccccugcaccucgggaagugcaacaucgccggcuggauccuggggaacccggagugcgagagcuucuccaccucguccagcugguccuacaucguggagaccagcuccucggacaacggcaagugcuaccccggcgacuucaucgacuacgaggagcugcgggagcagcucuccagcguguccucguucgagcgcuucgagaucuuccccaagaccuccagcuggcccaaccacgacuccaacaagggggucacgaccgccugcccgcacgccggcgccaagagcuucuacaagaaccugaucuggcuggugaagaaggggaacuccuacccccggcucucgaagagcuacaucaacgacaagggcaaggaggugcugguccugugggggauccaccaccccuccaccucggccgaccagcagucccucuaccagaacgcggacgccuacguguucgugggcaccagccgcuacuccaagaaguucaagcccgagaucgccauccggccgaagguccgcgaccaggagggccggaugaacuacuacuggacgcugguggagcccggggacaagaucaccuucgaggccaccggcaaccugguggucccccgcuacgccuucgcgauggagcggaacgccgggagcggcaucaucaucuccgacacccccgugcacggcugcaacacgaccugccagaccccgaagggggccaucaacaccucgcuccccuuccagaacauccaccccaucacgaucggcaagugccccaaguacgugaaguccaccaagcugcgccuggccaccgggcuccggaacgucccgagcauccagucccgcggccuguucggggccguggcgggcuucaucgagggcggguggaccggcaugguggacgggugguacggcuaccaccaccagaacgagcaggggucgggcuacgccgccgaccugaaguccacgcagaacgccaucgacgagaucaccaacaaggucaacagcgugaucgagaagaugaacacccaguucaccgccgucggcaaggaguucaaccaccucgagaagcggaucgagaaccugaacaagaagguggacgacggguuccuggacaucuggacguacaacgcggagcuccuggugcugcucgagaacgagcgcacccuggacuaccacgacuccaacgucaagaaccuguacgagaaggugcggagccagcucaagaacaacgccaaggagaucggcaacgggugcuucgaguucuaccacaagugcgacaacacgugcauggaguccgugaagaacggcaccuacgacuaccccaaguacucggaggaggccaagcugaaccgcgaggagaucgacggggucaagcuggaguccacccggaucuaccagauccucgccaucuacagcaccguggccucgucccuggugcuggucgugagccucggcgcgaucuccuucuggaugugcagcaacggcucccugcagugccgcaucugcaucuga

SEQ ID NO: 6397 - RNA, 1701 nt, Artificial Sequence; identical to SEQ ID NO: 3712
  derived and/or modified CDS sequence (AUadapt) from InfluenzaA__ADO29898__HA

SEQ ID NO: 6398 - RNA, 1701 nt, Artificial Sequence
  derived and/or modified CDS sequence (AUadapt) from InfluenzaA__ADO29899__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaccugcaucuga

SEQ ID NO: 6399 - RNA, 1701 nt, Artificial Sequence
  derived and/or modified CDS sequence (AUadapt) from InfluenzaA__ADO29900__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccagcuccgacaacggcacgugcuaccccggcgaccucaucgacuacgaggagcugcgggagcagcugucguccgugucguccuucgagcgcuucgagaucuuccccaagaccagcuccuggcccaaccacgaccucaacaagggggucaccgccgccugcccgcacgccggcgccaagucguucuacaagaaccugaucuggcuggugaagaaggggaacuccuaccccaagcucagcaaguccuacaucaacgacaagggcaaggaggugcugguccugugggggauccaccaccccucgaccucggccgaccagcagucccucuaccagaacgccgacgccuacguguucgugggcacgagccgguacuccaagaaguccaagcccgagaucgccauccgcccgaagguccgggaccaggagggccgcaugaacuacuacuggacccugguggagcccggggacaagaucaccuucgaggcgaccggcaaccugguggucccccgguacgccuucgccauggagcgcaacgccgggucgggcaucaucaucagcgacacgcccgugcacgacugcaacacgaccugccagaccccgaagggcgccaucaacaccucccuccccuuccagaacauccaccccaucaccaucgggaagugccccaaguacgugcggucgaccaagcugcgccuggcgaccggccuccggaacgucccguccauccagucgcgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccuggacaucugggccuacaacgccgagcuccuggugcugcucgagaacgagcgcacccuggacuaccacgacucgaacgugaagaaccuguacgagaagguccggucccagcucaagaacaacgccaaggagaucgggaacggcugcuucgaguucuaccacaagugcgacaacacgugcauggagagcgugaagaacgggaccuacgacuaccccaaguacuccgaggaggcgaagcugaaccgcgaggagaucgacggcgugaagcuggagucgacccggaucuaccagauccucgccaucuacuccaccgucgccucgagccuggugcugguggucucccucggggccaucucguucuggaugugcuccaacggcagccugcagugccgcaucugcaucuga

SEQ ID NO: 6400 - RNA, 1701 nt, Artificial Sequence
  derived and/or modified CDS sequence (AUadapt) from InfluenzaA__ADO29901__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgagaagcucugcaagcugcgcggggucgcgccccugcaccucggcaagugcaacaucgccggguggauccugggcaacccggagugcgagagccuguccaccgccucguccuggagcuacaucguggagaccuccucguccgacaacgggacgugcuaccccggcgacuucaucgacuacgaggagcuccgggagcagcugagcuccgugucguccuucgagcgcuucgagaucuuccccaagaccagcuccuggcccaaccacgacucgaacaagggcgucaccgccgccugcccgcacgccggggcgaaguccuucuacaagaaccugaucuggcucgccaagaagggcaacagcuaccccaagguguccaagucguacaucaacgacaaggggaaggaggugcugguccuguggggcauccaccaccccagcaccuccgccgaccagcagucgcucuaccagaacgccgacgccuacguguucguggggacgucccgguacagcaagaaguucaagcccgagaucgcgauccgcccgaagguccgggaccaggagggccgcaugaacuacuacuggacccugguggagcccggcgacaagaucaccuucgaggccaccgggaaccugguggucccccgguacgccuucgccauggagcgcaacgccggcuccgggaucaucaucucggacacgcccgugcacgacugcaacacgaccugccagaccccgaagggcgcgaucaacaccucccuccccuuccagaacauccaccccaucaccaucggcaagugccccaaguacgucaagagcaccaagcugcggcuggccaccgggcuccgcaacgugccguccauccagucgcggggccuguucggggccaucgccggcuucaucgagggcggguggacgggcaugguggacgggugguacggcuaccaccaccagaacgagcagggguccggcuacgccgcggaccucaagagcacccagaacgccaucgacgagaucaccaacaaggugaacuccgucaucgagaagaugaacacccaguucacggccguggggaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacucgaacgugaagaaccuguacgagaagguccgcucccagcucaagaacaacgccaaggagaucggcaacgggugcuucgaguucuaccacaagugcgacaacacgugcauggagagcgugaagaacggcaccuacgacuaccccaaguacuccgaggaggcgaagcugaaccgggaggagaucgacggggugaagcuggagucgacccgcaucuaccagauccucgccaucuacuccaccgucgccagcucgcuggugcugguggucucccucggcgccaucagcuucuggaugugcuucaacgggucccugcagugccggaucugcaucuga

SEQ ID NO: 6401 - RNA, 1701 nt, Artificial Sequence
  derived and/or modified CDS sequence (AUadapt) from InfluenzaA__ADO29902__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacacgugcauggagggggugaagaacggcaccuacgacuaccccaaguacagcgaggaggccaagcugaaccgggaggagaucgacggggugaagcucgaguccacccgcaucuaccagauccuggcgaucuacucgaccgucgccuccagccuggugcucguggucucgcugggcgccaucuccuucuggaugugcagcaacggcucccugcagugccggaucugcaucuga

SEQ ID NO: 6402 - RNA, 1701 nt, Artificial Sequence
  derived and/or modified CDS sequence (AUadapt) from InfluenzaA__ADO29903__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaccgccggcuggauccuggggaacccggagugcgagucgcuguccaccgcgagcuccuggucguacaucguggagacguccagcuccgacaacgggaccugcuaccccggcgacuucaucgacuacgaggagcuccgggagcagcugucguccgugucguccuucgagcgcuucgagaucuuccccaagaccagcuccuggcccaaccacgacccgaacaagggcgucaccgccgccugcccccacgccggcgccaagucguucuacaagaaccugaucuggcucgugaagaaggggaacuccuaccccaagcugagcaaguccuacaucaacgacaagggcaaggaggugcugguccucugggggauccaccaccccucgacgagcgccgaccagcagucccuguaccagaacgccgacgccuacguguucgugggcaccucgcgguacuccaagaaguucaagccggagaucgccauccgccccaagguccgggaccaggagggccgcaugaacuacuacuggacccugguggagcccggggacaagaucaccuucgaggcgacgggcaaccucguggucccccgguacgccuucgccauggagcgcaacgccgggucgggcaucaucaucuccgacaccccggugcacgacugcaacacgaccugccagacccccaagggcgccaucaacaccagccugcccuuccagaacauccaccccaucaccaucgggaagugcccgaaguacgugaaguccaccaagcugcggcucgcgacgggccugcgcaacguccccucgauccagucccgggggcuguucggcgccaucgccggguucaucgagggcggcuggaccgggaugguggacggcugguacggguaccaccaccagaacgagcagggcagcggguacgccgccgaccucaaguccacccagaacgcgaucgacgagaucaccaacaaggugaacucggucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 6403 - RNA, 1701 nt, Artificial Sequence
  derived and/or modified CDS sequence (AUadapt) from InfluenzaA__ADO29904__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggcggugcaacaucgccggcuggauccuggggaacccggagugcgagucgcuguccaccgcgagcuccuggucguacaucguggagaccuccagcuccgacaacggcacgugcuaccccggcgacuucaucgacuacgaggagcuccgcgagcagcugucguccgugagcuccuucgagcgguucgagaucuuccccaagaccucguccuggcccaaccacgacccgaacaagggggucaccgccgccugcccccacgccggcgccaagagcuucuacaagaaccugaucuggcucgugaagaaggggaacuccuaccccaagcugucgaaguccuacaucaacgacaagggcaaggaggugcugguccucugggggauccaccgccccagcaccucggccgaccagcagucccuguaccagaacgccgacgccuacguguucgugggcacgucgcgguacuccaagaaguucaagccggagaucgccauccgccccaaggucggcgaccaggaggggcggaugaacuacuacuggacccugguggagcccggcgacaagaucaccuucgaggcgaccgggaaccucguggucccccgcuacgccuucgccauggagcggaacgccggcagcggcaucaucaucuccaacacgccggugcacgacugcaacacgaccugccagacccccaagggggccaucaacaccucgcugcccuuccagaacauccaccccaucaccaucggcaagugcccgaaguacgugaaguccaccaagcugcgccucgcgaccgggcugcggaacguccccagcauccagucccgcggccuguucggggccaucgccggcuucaucgagggcggguggacgggcaugguggacgggugguacggcuaccaccaccagaacgagcaggggucgggcuacgccgccgaccucaaguccacccagaacgcgaucgacgagaucaccaacaaggugaacagcgucaucgagaagaugaacacccaguucacggccgugggcaaggaguucaaccaccuggagaagcggaucgagaaccugaacaagaaggucgacgacggguuccucgacaucuggaccuacaacgccgagcugcuggugcuccuggagaacgagcgcacccuggacuaccacgacuccaacgugaagaaccucuacgagaagguccggucgcagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgcgaggagaucgacggggugaagcucgaguccacccggaucuaccagauccuggcgaucuacucgaccgucgccuccagccuggugcucguggucucgcugggcgccaucuccuucuggaugugcagcaacggcucccugcagugccgcaucugcaucuga

SEQ ID NO: 6404 - RNA, 1701 nt, Artificial Sequence
  derived and/or modified CDS sequence (AUadapt) from InfluenzaA__ADO29905__HA
augaaggccauccuggugguccuccuguacaccuucgccaccgcgaacgccgacacgcugugcaucggcuaccacgccaacaacucgaccgacaccguggacaccgugcucgagaagaacgucacggugacccgcuccgugaaccugcuggaggacaagcacaacgggaagcucugcaagcugcggggcgucgcgccccugcaccucgggaagugcaacaucgccggcuggauccuggggaacccggagugcgagucgcuguccaccgcgagcuccuggucguacaucguggagaccuccagcuccgacaacggcacgugcuaccccggcgacuucaucgacuacgaggagcuccgcgagcagcugucguccgugagcuccuucgagcgguucgagaucuuccccaagaccucguccuggcccaaccacgacccgaacaagggggucaccgccgccugcccccacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacguguucgugggcacgucgcgcuacuccaagaaguucaagccggagaucgccauccggcccaagguccgcgaccaggagggccggaugaacuacuacuggacccugguggagcccggggacaagaucaccuucgaggcgaccggcaaccucguggucccccgcuacgccuucgccauggagcggaacgccgggagcggcaucaucaucuccaacacgccggugcacgacugcaacacgaccugccagacccccaagggcgccaucaacaccucgcugcccuuccagaacauccaccccaucaccaucgggaagugcccgaaguacgugaaguccaccaagcugcgccucgcgaccggccugcggaacguccccagcauccagucccgcgggcuguucggcgccaucgccggguucaucgagggcggcuggacggggaugguggacggcugguacggguaccaccaccagaacgagcagggcucgggguacgccgccgaccucaaguccacccagaacgcgaucgacgagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaacgugaagaaccucuacgagaagguccggucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgugaagcucgaguccacccggaucuaccagauccuggcgaucuacucgaccgucgccuccagccuggugcucguggucucgcugggggccaucuccuucuggaugugcagcaacggcucccugcagugccgcaucugcaucuga

SEQ ID NO: 6405 - RNA, 1701 nt, Artificial Sequence
  derived and/or modified CDS sequence (AUadapt) from InfluenzaA__ADO29906__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaaccgcaagcucugcaagcugcgcggggucgcgccccugcaccucggcaagugcaacaucgccggguggauccugggcaacccggagugcgagucgcuguccaccgcgagcuccuggucguacaucguggagaccuccagcuccgacaacgggacgugcuaccccggcgacuucaucgacuacgaggagcuccgggagcagcugucguccgugagcuccuucgagcgguucgagaucuuccccaagaccucguccuggcccaaccacgacccgaacaagggcgucaccgccgccugcccccacgccggggccaagagcuucuacaagaaccugaucuggcucgugaagaagggcaacuccuaccccaagcugucgaaguccuacaucaacgacaaggggaaggaggugcugguccucuggggcauccaccaccccagcaccucggccgaccagcagucccuguaccagaacgccgacgccuacguguucguggggacgucgcgcuacuccaagaaguucaagccggagaucgccauccggcccaagguccgcgaccaggagggccggaugaacuacuacuggacccugguggagcccggcgacaagaucaccuucgaggcgaccgggaaccucguggucccccgcuacgccuucgccauggagcggaacgccggcagcgggaucaucaucuccgacacgccggugcacgacugcaacacgaccugccagacccccaagggcgccaucaacaccucgcugcccuuccagaacauccaccccaucaccaucggcaagugcccgaaguacgugaaguccaccaagcugcgccucgcgaccgggcugcggaacguccccagcauccagucccgcggccuguucggggccaucgccggcuucaucgagggcggguggacgggcaugguggacgggugguacggcuaccaccaccagaacgagcaggggucgggcuacgccgccgaccucaaguccacccagaacgcgaucgacgagaucaccaacaaggugaacagcgucaucgagaagaugaacacccaguucacggccguggggaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaacgugaagaaccucuacgagaagguccggucgcagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgcgaggagaucgacggggugaagcucgaguccacccggaucuaccagauccuggcgaucuacucgaccgucgccuccagccuggugcucguggucucgcugggcgccaucuccuucuggaugugcagcaacgggucccugcagugccgcaucugcaucuga

SEQ ID NO: 6406 - RNA, 1701 nt, Artificial Sequence
  derived and/or modified CDS sequence (AUadapt) from InfluenzaA__ADO29907__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacccgaacaagggggucaccgccgccugcccccacgccggcgccaagucguucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacguguucgugggcacgucgcgguacuccaagaagcugaagccggagaucgccauccgccccaagguccgggaccaggagggccgcaugaacuaccacuggacccucguggagcccggggacaagaucaccuucgaggcgaccggcaaccugguggucccccgguacgccuucgccauggagcgcaacgccgggagcggcaucaucaucuccgacacgccggugcacgacugcaacacgaccugccagacccccaagggcgccaucaacaccucgcugcccuuccagaacauccaccccaucaccaucgggaagugcccgaaguacgugaaguccaccaagcuccggcuggcgaccggccugcgcaacguccccagcauccagucccggggccucuucggggccaucgccggguucaucgagggcggcuggacggggaugguggacggcugguacggguaccaccaccagaacgagcagggcucgggguacgccgccgaccugaaguccacccagaacgcgaucgacgagaucaccaacaaggugaacucggucaucgagaagaugaacacccaguucacggccgugggcaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacuccaacgugaagaaccuguacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcucaaccgggaggagaucgacggcgugaagcuggaguccacccgcaucuaccagauccuggcgaucuacucgaccgucgccuccagccucgugcugguggucucgcugggggccaucuccuucuggaugugcagcaacggcucccuccagugccggaucugcaucuga

SEQ ID NO: 6407 - RNA, 1701 nt, Artificial Sequence
  derived and/or modified CDS sequence (AUadapt) from InfluenzaA__ADO29908__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacccgaacaagggggucaccgccgccugcccccacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacguguucgugggcacgucgcgguacuccaagaaguucaagccggagaucgccauccgccccaagguccgggaccaggaguggcgcaugaacuacuacuggacccugguggagcccggcgacaagaucaccuucgaggcgaccgggaaccucguggucccccgguacgccuucgccauggagcgcaacgccggcagcgggaucaucaucuccgacacgccggugcacgacugcaacacgaccugccagacccccaagggcgccaucaacaccucgcugcccuuccagaacauccaccccaucaccaucggcaagugcccgaaguacgugaaguccaccaagcugcggcucgcgaccgggcugcgcaacguccccagcauccagucccggggccuguucggggccaucgccggcuucaucgagggcggguggacgggcaugguggacgggugguacggcuaccaccaccagaacgagcaggggucgggcuacgccgccgaccucaaguccacccagaacgcgaucgacgagaucaccaacaaggugaacagcgucaucgagaagaugaacacccaguucacggccguggggaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcgucuaccagauccuggcgaccuacucgaccguggccuccagccuggugcucgucgugucgcugggcgccaucuccuucuggaugugcagcaacgggucccugcagugccggaucugcaucuga

SEQ ID NO: 6408 - RNA, 1701 nt, Artificial Sequence
  derived and/or modified CDS sequence (AUadapt) from InfluenzaA__ADO29909__HA
augaaggccauccuggugguccuccuguacaccuucgccaccgcgaacgccgacacgcugcgcaucggcuaccacgccaacaacucgaccgacaccguggacaccgugcucgagaagaacgucacggugacccacuccgugaaccugcuggaggacaagcacaacgggaagcucugcaagcugcggggcgucgcgccccugcaccucgggaagugcaacaucgccggcuggauccuggggaacccggagugcgagucgcuguccaccgcgagcuccuggucguacaucguggagaccuccagcuccgacaacggcacgugcuaccccggcgacuucaucgacuacgaggagcuccgcgagcagcugucguccgugagcuccuucgagcgguucgagaucuuccccaagaccucguccuggcccaaccacgacccgaacaagggggucaccgccgccugcccccacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacguguucgugggcacgucgcgcuacuccaagaaguucaagccggagaucgccauccggcccaagguccgcgaccaggagggccggaugaacuacuacuggacccugguggagcccggggacaagaucaccuucgaggcgaccggcaaccucguggucccccgcuacgccuucgccauggagcggaacgccgggagcggcaucaucaucuccgacacgccggugcacgacugcaacacgaccugccagacccccaagggcgccaucaacaccucgcugcccuuccagaacauccaccccaucaccaucgggaagugcccgaaguacgugaaguccaccaagcugcgccucgcgaccggccugcggaacguccccagcauccagucccgcgggcuguucggcgccaucgccggguucaucgagggcggcuggacggggaugguggacggcugguacggguaccaccaccagaacgagcagggcucgggguacgccgccgaccucaaguccauccagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgugaagcucgaguccacccggaucuaccagauccuggcgaucuacucgaccgucgccuccagccugauccucguggugucgcugggggccaucuccuucuggaugugcagcaacggcucccugcagugccgcaucugcaucuga

SEQ ID NO: 6409 - RNA, 1701 nt, Artificial Sequence
  derived and/or modified CDS sequence (AUadapt) from InfluenzaA__ADO29910__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagccccgcggcgucgccccgcugcaccuggggaagugcaacaucgccggcuggauccucgggaaccccgagugcgagucgcuguccaccgcgagcuccuggucguacaucguggagaccuccagcuccgacaacggcacgugcuaccccggcgacuucaucgacuacgaggagcugcgggagcagcucucguccgugagcuccuucgagcgcuucgagaucuuccccaagaccucguccuggccgaaccacgaccccaacaagggggucaccgccgccugcccccacgccggcgccaagagcuucuacaagaaccugaucuggcuggugaagaaggggaacuccuaccccaagcucucgaaguccuacaucaacgacaagggcaaggaggugcugguccugugggggauccaccacccgagcaccucggcggaccagcagucccucuaccagaacgccgacgccuacguguucgugggcacgucgcgguacuccaagaaguucaagcccgagaucgccauccgccccaagguccgggaccaggagggccgcaugaacuacuacuggacccugguggagcccggggacaagaucaccuucgaggcgaucggcaaccugguggucccgcgguacgccuucgccauggagcgcaacgccgggagcggcaucaucaucuccgacacccccgugcacgacugcaacacgaccugccagacccccaagggcgccaucaacaccucgcuccccuuccagaacauccacccgaucacgaucgggaagugccccaaguacgugaaguccaccaagcugcggcuggcgaccggccuccgcaacguccccagcauccagucccgggggcuguucggcgccaucgccggguucaucgagggcggcuggaccgggaugguggacggcugguacggguaccaccaccagaacgagcagggcucgggguacgccgccgaccugaaguccacgcagaacgcgaucgacgagaucaccaacaaggugaacagcgucaucgagaagaugaacacccaguucaccgccgugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcucgcagcucaagaacaacgccaaggagaucgggaacggcugcuucgaguucuaccacaagugcgacaacacgugcauggaguccgugaagaacgggaccuacgacuaccccaaguacagcgaggaggccaagcugaaccggggcgagaucgacggggugaagcuggaguccacccgcaucuaccagauccucgcgaucuacucgaccgucgccuccagccuggugcugguggucucgcucggcgccaucuccuucuggaugugcagcaacggcucccugcagugccggaucugcaucuga

SEQ ID NO: 6410 - RNA, 1701 nt, Artificial Sequence; identical to SEQ ID NO: 4636
  derived and/or modified CDS sequence (AUadapt) from InfluenzaA__ADO30407__HA

SEQ ID NO: 6411 - RNA, 1701 nt, Artificial Sequence; identical to SEQ ID NO: 4527
  derived and/or modified CDS sequence (AUadapt) from InfluenzaA__ADO30417__HA

SEQ ID NO: 6412 - RNA, 1701 nt, Artificial Sequence; identical to SEQ ID NO: 4249
  derived and/or modified CDS sequence (AUadapt) from InfluenzaA__ADO33202__HA

SEQ ID NO: 6413 - RNA, 1701 nt, Artificial Sequence; identical to SEQ ID NO: 3757
  derived and/or modified CDS sequence (AUadapt) from InfluenzaA__ADO33240__HA

SEQ ID NO: 6414 - RNA, 1701 nt, Artificial Sequence; identical to SEQ ID NO: 116
  derived and/or modified CDS sequence (AUadapt) from InfluenzaA__ADO33247__HA

SEQ ID NO: 6415 - RNA, 1701 nt, Artificial Sequence; identical to SEQ ID NO: 3757
  derived and/or modified CDS sequence (AUadapt) from InfluenzaA__ADO33254__HA

SEQ ID NO: 6416 - RNA, 1701 nt, Artificial Sequence; identical to SEQ ID NO: 3757
  derived and/or modified CDS sequence (AUadapt) from InfluenzaA__ADO33261__HA

SEQ ID NO: 6417 - RNA, 1701 nt, Artificial Sequence; identical to SEQ ID NO: 3757
  derived and/or modified CDS sequence (AUadapt) from InfluenzaA__ADO33269__HA

SEQ ID NO: 6418 - RNA, 1701 nt, Artificial Sequence; identical to SEQ ID NO: 4249
  derived and/or modified CDS sequence (AUadapt) from InfluenzaA__ADO33277__HA

SEQ ID NO: 6419 - RNA, 1701 nt, Artificial Sequence; identical to SEQ ID NO: 3757
  derived and/or modified CDS sequence (AUadapt) from InfluenzaA__ADO33285__HA

SEQ ID NO: 6420 - RNA, 1701 nt, Artificial Sequence; identical to SEQ ID NO: 4249
  derived and/or modified CDS sequence (AUadapt) from InfluenzaA__ADO33293__HA

SEQ ID NO: 6421 - RNA, 1701 nt, Artificial Sequence; identical to SEQ ID NO: 4249
  derived and/or modified CDS sequence (AUadapt) from InfluenzaA__ADO33307__HA

SEQ ID NO: 6422 - RNA, 1701 nt, Artificial Sequence; identical to SEQ ID NO: 3757
  derived and/or modified CDS sequence (AUadapt) from InfluenzaA__ADO33313__HA

SEQ ID NO: 6423 - RNA, 1701 nt, Artificial Sequence; identical to SEQ ID NO: 6007
  derived and/or modified CDS sequence (AUadapt) from InfluenzaA__ADO33329__HA

SEQ ID NO: 6424 - RNA, 1701 nt, Artificial Sequence; identical to SEQ ID NO: 3757
  derived and/or modified CDS sequence (AUadapt) from InfluenzaA__ADO33337__HA

SEQ ID NO: 6425 - RNA, 1701 nt, Artificial Sequence; identical to SEQ ID NO: 3757
  derived and/or modified CDS sequence (AUadapt) from InfluenzaA__ADO33345__HA

SEQ ID NO: 6426 - RNA, 1701 nt, Artificial Sequence; identical to SEQ ID NO: 4249
  derived and/or modified CDS sequence (AUadapt) from InfluenzaA__ADO33352__HA

SEQ ID NO: 6427 - RNA, 1701 nt, Artificial Sequence; identical to SEQ ID NO: 116
  derived and/or modified CDS sequence (AUadapt) from InfluenzaA__ADO33360__HA

SEQ ID NO: 6428 - RNA, 1701 nt, Artificial Sequence; identical to SEQ ID NO: 3757
  derived and/or modified CDS sequence (AUadapt) from InfluenzaA__ADO33368__HA

SEQ ID NO: 6429 - RNA, 1701 nt, Artificial Sequence; identical to SEQ ID NO: 3757
  derived and/or modified CDS sequence (AUadapt) from InfluenzaA__ADO33376__HA

SEQ ID NO: 6430 - RNA, 1701 nt, Artificial Sequence; identical to SEQ ID NO: 62
  derived and/or modified CDS sequence (AUadapt) from InfluenzaA__ADO33384__HA

SEQ ID NO: 6431 - RNA, 1701 nt, Artificial Sequence; identical to SEQ ID NO: 116
  derived and/or modified CDS sequence (AUadapt) from InfluenzaA__ADO33391__HA

SEQ ID NO: 6432 - RNA, 1701 nt, Artificial Sequence
  derived and/or modified CDS sequence (AUadapt) from InfluenzaA__ADO79917__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccgcgagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacaacugcaacacgaccugccagaccccgaagggcgccaucaacaccucccugcccuuccagaacauccaccccaucaccaucgggaagugccccaaguacgucaagucgaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggcgaucuacuccaccgucgccucgagccuggugcucguggucucccugggggccaucucguucuggaugugcuccaacggcagccugcagugccgcaucugcaucuga

SEQ ID NO: 6433 - RNA, 1701 nt, Artificial Sequence
  derived and/or modified CDS sequence (AUadapt) from InfluenzaA__ADO79923__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgucguccuggagcuacaucguggagaccuccucgacggacaaguggaccugcuaccccggcgacuucaucgacuacgaggagcuccgggagcagcuguccagcguguccucguucgagcgcuucgagaucuuccccaagaccuccagcuggcccaaccacgacuccaacaagggcgucaccgccgccugcccgcacgccggggccaagucguucuacaagaaccugaucuggcucgugaagaagggcaacuccuaccccaagcugagcaaguccuacaucaacgacaaggggaaggaggugcugguccucuggggcauccaccaccccucgacgagcgccgaccagcagucccuguaccagaacgccgacgccuacguguucguggggaccucgcgguacuccaagaaguucaagcccgagaucgccauccgcccgaagguccgggaccaggagcgccggaugaacuacuacuggacccuggugcagcccggcgacaagaucaccuuccaggcgacgggcaaccucguggucccccgcuacgccuucgccauggagcggaacgccgggagcggcaucaucaucuccgacacccccgugcacaacugcaacacgaccugccagaccccgaagggggccaucaacaccucgcugcccuuccagaacauccaccccaucaccaucggcaagugccccaaguacgugaaguccaccaagcugcgccucgcgacgggccugcggaacgucccgagcauccagucccgcgggcuguucggcgccaucgccggguucaucgagggcggguggaccggcaugguggacggcugguacggguaccaccaccagaacgagcagggcucgggguacgccgccgaccucaaguccacccagaacgcgaucgacgagaucaccaacaaggugaacagcgucaucgagaagaugaacacgcaguucaccgccgugggcaaggaguucaaccaccuggagaagcggaucgagaaccugaacaagaaggucgacgacggguuccucgacaucuggaccuacaacgccgagcugcuggugcuccuggagaacgagcgcacccuggacuaccacgacuccaacgugaagaaccucuacgagaagguccggucgcagcugaagaacaacgccaaggagaucggcaacggcugcuucgaguucuaccacaagugcgacaacacgugcauggaguccgugaagaacgggaccuacgacuaccccaaguacagcgaggaggccaagcugaaccgcgaggagaucgacggcgugaagcucgaguccacccggaucuaccagauccuggcgaucuacucgaccgucgccuccagccuggugcucguggucucgcugggggccaucuccuucuggaugugcagcaacggcucccugcagugccgcaucugcaucuga

SEQ ID NO: 6434 - RNA, 1701 nt, Artificial Sequence
  derived and/or modified CDS sequence (AUadapt) from InfluenzaA__ADO79924__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgucguccuggagcuacaucguggagaccuccucgacggacaaguggaccugcuaccccggcgacuucaucgacuacgaggagcuccgggagcagcuguccagcguguccucguucgagcgcuucgagaucuuccccaagaccuccagcuggcccaaccacgacuccaacaagggcgucaccgccgccugcccgcacgccggggccaagucguucuacaagaaccugaucuggcucgugaagaagggcaacuccuaccccaagcugagcaaguccuacaucaacgacaaggggaaggaggugcugguccucuggggcauccaccaccccucgacgagcgccgaccagcagucccuguaccagaacgccgacgccuacguguucguggggaccucgcgguacuccaagaaguucaagcccgagaucgccauccgcccgaagguccgggaccgcgagggccggaugaacuacuacuggacccugaucgagcccggcgacaagaucaccuucgagcccacggggaaccucguggugccccgcuacgcguucgccauggagcggaacgccggcagcgggaucaucaucuccgacaccccgguccacaacugcaacacgaccugccagacccccaagggcgccaucaacaccucgcugcccuuccagaacauccaccccaucaccaucggcaagugcccgaaguacgugaaguccaccaagcugcgccucgccacggggcugcggaacgugcccagcauccagucccgcggccuguucggggcgaucgccggcuucaucgagggcggguggaccggcauggucgacgggugguacggcuaccaccaccagaacgagcaggggucgggcuacgccgccgaccucaaguccacccagaacgccaucgacgagaucaccaacaaggugaacagcgugaucgagaagaugaacacgcaguucaccgcggucgggaaggaguucaaccaccuggagaagcggaucgagaaccugaacaagaagguggacgacggcuuccucgacaucuggaccuacaacgccgagcugcugguccuccuggagaacgagcgcacccuggacuaccacgacuccaacgugaagaaccucuacgagaaggugcggucgcagcugaagaacaacgccaaggagaucggcaacgggugcuucgaguucuaccacaagugcgacaacacgugcauggaguccgucaagaacggcaccuacgacuaccccaaguacagcgaggaggccaagcugaaccgcgaggagaucgacggggugaagcucgaguccacccggaucuaccagauccuggccaucuacucgaccguggcguccagccugguccucguggugucgcugggcgccaucuccuucuggaugugcagcaacgggucccugcagugccgcaucugcaucuga

SEQ ID NO: 6435 - RNA, 1701 nt, Artificial Sequence
  derived and/or modified CDS sequence (AUadapt) from InfluenzaA__ADO79925__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgucguccuggagcuacaucguggagaccuccucgacgcacgaguggaccugcuaccccggcgacuucaucgacuacgaggagcuccgggagcagcuguccagcguguccucguucgagcgcuucgagaucuuccccaagaccuccagcuggcccaaccacgacuccaacaagggcgucaccgccgccugcccgcacgccggggccaagucguucuacaagaaccugaucuggcucgugaagaagggcaacuccuaccccaagcugagcaaguccuacaucaacgacaaggggaaggaggugcugguccucuggggcauccaccaccccucgacgagcgccgaccagcagucccuguaccagaacgccgacgccuacguguucguggggaccucgcgguacuccaagaaguucaagcccgagaucgccauccgcccgaagguccgggaccgcgagggccggaugaacuacuacuggacccugguggagcccggcgacaagaucaccuucgaggcgcccgggaaccucguggucccccgcuacgccuucgccauggagcggaacgccggcagcgggaucaucaucuccgacacgccggugcacaacugcaacacgaccugccagacccccaagggcgccaucaacaccucgcugcccuuccagaacauccaccccaucaagaucggcaagugcuccaaguacgucaagagcaccaagcugcgccucgcgaccgggcugcggaacgugccguccauccagucgcgcggccuguucggggccaucgccggcuucaucgagggcggguggaccggcaugguggacgggugguacggcuaccaccaccagaacgagcagggguccggcuacgccgccgaccucaagagcacgcagaacgcgaucgacgagaucaccaacaaggugaacuccgucaucgagaagaugaacacccaguucaccgccguggggaaggaguucaaccaccuggagaagcggaucgagaaccugaacaagaaggucgacgacggcuuccucgacaucuggacguacaacgccgagcugcuggugcuccuggagaacgagcgcacccuggacuaccacgacucgaacgugaagaaccucuacgagaagguccggucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgcgaggagaucgacggggugaagcucgagucgacccggaucuaccagauccuggcgaucuacuccaccgucgccagcucgcuggugcucguggucucccugggcgccaucagcuucuggaugugcuccaacgggagccugcagugccgcaucugcaucuga

SEQ ID NO: 6436 - RNA, 1701 nt, Artificial Sequence
  derived and/or modified CDS sequence (AUadapt) from InfluenzaA__ADO79926__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgucguccuggagcuacaucguggagaccuccucgacggacaaguggaccugcuaccccggcgacuucaucgacuacgaggagcuccgggagcagcuguccagcguguccagcuucgagcgcuucgagaucuuccccaagaccuccucguggcccaaccacgacuccaacaagggcgucaccgccgccugcccgcacgccggggccaagagcuucuacaagaaccugaucuggcucgugaagaagggcaacuccuucucgaagcuguccaagacguaccugaacgacaaggggaaggaggugcucguccuguggggcauccaccaccccagcaccagcgccgaccagcagucccuguaccagaacgccgacgccuacguguucguggggaccucgcgguacuccaagaaguucaagcccgagaucgccauccgccccaagguccgggaccaggagggccgcaugaacuacuacuggacccucguggagccgggcgacaagaucacguucgaggcgaccgggaaccugguggucccccgguacgccuucgccauggagcgcaacgugggcagcgggaucaucaucuccgacacccccgugcacgacugcaacaccacgugccagacccccaagggcgccaucaacaccucgcugccguuccagaacauccaccccaucaccaucggcaagugccccaaguacgucaaguccacgaagcuccggcuggccaccgggcugcgcaacgugcccagcauccagucccggggccucuucggggcgaucgccggcuucaucgagggcggguggaccggcaugguggacgggugguacggcuaccaccaccagaacgagcaggggucgggcuacgccgccgaccugaaguccacccagaacgccaucgacaagaucacgaacaaggucaacagcgugaucgagaagaugaacacccaguucaccgcggucgggaaggaguucaaccaccuggagaagcgcaucgagaaccucaacaagaagguggacgacggcuuccuggacaucuggaccuacaacgccgagcugcucgugcugcuggagaacgagcggacgcucgacuaccacgacuccaacgucaagaaccuguacgagaaggugcgcagccagcugaagaacaacgccaaggagaugaagaacggcugcuucgaguucuaccacaagugcgacaacacgugcauggaguccgugaagaacgggaccuacgacuacccgaaguacucggaggaggccaagcucaaccgggaggagaucgacggcgucaagcuggaguccacccgcaucuaccagauccuggccaucuacagcaccguggcguccucgcucgugcuggucgugagccugggggccaucuccuucuggaugugcagcaacggcucccuccagugccggaucugcaucuga

SEQ ID NO: 6437 - RNA, 1701 nt, Artificial Sequence
  derived and/or modified CDS sequence (AUadapt) from InfluenzaA__ADO79927__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucgacggacaaguggaccugcuaccccggcgacuucaucgacuacgaggagcuccgggagcagcuguccagcguguccucguucgagcgcuucgagaucuuccccaagaccuccagcuggcccaaccacgacuccaacaagggcgucaccgccgccugcccgcacgccgcggccaagucguucuacaagaaccugaucuggcucgugaagaaggggaacuccuaccccaagcugagcaaguccuacaucaacgacaagggcaaggaggugcugguccucugggggauccaccaccccucgacgagcgccgaccagcagucccuguaccagaacgccgacgccuacguguucgugggcaccucgcgguacuccaagaaguucaagcccgagaucgcgauccgcccgaagguccgggaccaggaggggcgcaugaacuacuacuggacccugguggagcccggcgacaagaucaccuucgaggccacgggcaaccucguggucccccgguacgccuucgccauggagcgcaacgccgggagcggcaucaucaucuccgacacccccgugcacgacugcaacacgaccugccagaccccgaagggggcgaucaacaccucgcugcccuuccagaacauccaccccaucaccaucggcaagugccccaaguacgugaaguccaccaagcugcggcucgccacgggccugcgcaacaucccgagcguccagucccgggggcuguucggcgccaucgccggguucaucgagggcggguggaccggcaugguggacggcugguacggguaccaccaccagaacgagcagggcucgggguacgccgcggaccucaaguccacccagaacgccaucgacaagaucaccaacaaggugaacagcgucaucgagaagaugaacacgcaguucaccgccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacuccaacgugaagaaccucuacgagaagguccgcucgcagcugaagaacaacgccaaggagaugaagaacggcugcuucgaguucuaccacaagugcgacaacacgugcauggaguccgugaagaacggcaccuacgacuaccccaaguacagcgaggaggcgaagcugaaccgggaggagaucgacggggugaagcucgaguccacccgcaucuaccagauccuggccaucuacucgaccgucgccuccagccuggugcucguggucucgcugggcgccaucuccuucuggaugugcagcaacgggucccugcagugccggaucugcaucuga

SEQ ID NO: 6438 - RNA, 1701 nt, Artificial Sequence
  derived and/or modified CDS sequence (AUadapt) from InfluenzaA__ADO79928__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcacggacaaguggaccugcuaccccggcgacuucaucgacuacgaggagcuccgggagcagcuguccucgguguccagcuucgagcgcuucgagaucuuccccaagaccaacuccuggcccaaccacgacucgaacaagggcgucaccgccgccugcccgcacgccggggcgaaguccuucuacaagaaccugaucuggcucgugaagaagggcaacagcuaccccaagcuguccaagucguacaucaacgacaaggggaaggaggugcugguccucuggggcauccaccaccccuccacgagcgccgaccagcagucgcuguaccagaacgccgacgccuacguguucguggggaccuccaaguacucgaagaaguucaagcccgagaucgccauccggccgaagguccgcgaccaggagggccggaugaacuacuacuggacccugguggagcccggcgacaagaucaccuucgaggcgacggggaaccucguggucccccgcuacgccuucgccauggagcggaacgccggcuccgggaucaucaucagcgacacccccgugcacgacugcaacacgaccugccagaccccgaagggcgccaucaacaccucccugcccuuccagaacauccaccccaucaccaucggcaagugccccaaguacgucaagucgaccaagcugcgccucgcgacggggcugcggaacgugccguccauccagagccgcggccuguucggggccaucgccggcuucaucgagggcggguggaccggcaugguggacgggugguacggcuaccaccaccagaacgagcagggguccggcuacgccgccgaccucaagucgacccagaacgcgaucgacgagaucaccaacaaggugaacuccgucaucgagaagaugaacacgcaguucaccgccguggggaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgcgaggagaucgacggggugaagcucgagagcacccggaucuaccagauccuggcgaucuacuccaccgucgccucgucccuggugcucguggucagccugggcgccaucucguucuggaugugcuccaacgggagccugcagugccgcaucugcaucuga

SEQ ID NO: 6439 - RNA, 1701 nt, Artificial Sequence
  derived and/or modified CDS sequence (AUadapt) from InfluenzaA__ADO79929__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgucguccuggagcuacaucguggagaccuccucgacggacaaguggaccugcuaccccggcgacuucaucgacuacgaggagcuccgggagcagcuguccagcguguccucguucgagcgcuucgagaucuuccccaagaccuccagcuggcccaaccacgacuccaacaagggcgucaccgccgccugcccgcacgccggggccaagucguucuacaagaaccugaucuggcucgugaagaagggcaacuccuaccccaagcugagcaaguccuacaucaacgacaaggggaaggaggugcugguccucuggggcauccaccaccccucgacgagcgccgaccagcagucccuguaccagaacgccgacgccuacguguucguggggaccucgcgguacuccaagaaguucaagcccgagaucgccauccgcccgaagguccggggccaggagggccgcaugaacuacuacuggacccugguggagcccggggacaagaucaccuucgaggcgacgggcaaccucguggucccccgguacgccuucgccauggagcgcaacgccgggagcggcaucaucaucuccgacacccccgugcacgacugcaacacgaccugccagaccccgaagggcgccaucaacaccucgcugcccuuccagaacauccaccccaucaccaucgggaagugccccaaguacgugaaguccaccaagcugcggcucgcgacgggccugcgcaacaucccgagcauccagucccgggggcuguucggcgccaucgccggguucaucgagggcggcuggaccgggauggucgacggcugguacggguaccaccaccagaacgagcagggcucgggguacgccgccgaccucaaguccacccagaacgcgaucgacgagaucaccaacaaggugaacagcgugaucgagaagaugaacacgcaguucaccgccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcucgcagcugaagaacaacgccaaggagaucgggaacggcugcuucgaguucuaccacaagugcgacaacacgugcauggaguccgucaagaacgggaccuacgacuaccccaaguacagcgaggaggccaagcugaaccgggaggagaucgacggcgugaagcucgaguccacccgcaucuaccagauccuggcgaucuacucgaccguggccuccagccugguccucguggugucgcugggggccaucuccuucuggaugugcagcaacggcucccugcagugccggaucugcaucuga

SEQ ID NO: 6440 - RNA, 1701 nt, Artificial Sequence
  derived and/or modified CDS sequence (AUadapt) from InfluenzaA__ADO79930__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgucguccuggagcuacaucguggagaccuccucgacggacaaguggaccugcuaccccggcgacuucaucgacuacgaggagcuccgggagcagcuguccagcguguccucguucgagcgcuucgagaucuuccccaagaccuccagcuggcccaaccacgacuccaacaagggcgucaccgccgccugcccgcacgccggggccaagucguucuacaagaaccugaucuggcucgugaagaagggcaacuccuaccccaagcugagcaaguccuacaucaacgacaaggggaaggaggugcugguccucuggggcauccaccaccccucgacgagcgccgaccagcagucccuguaccagaacgccgacgccuacguguucguggggaccucgcgguacuccaagaaguucaagcccgagaucgccauccgcccgaagguccgggaccgcgagggccggaugaacuacuacuggacccugguggagcccggcgacaagaucaccuucgaggcgacggggaaccucguggucccccgcuacgccuucgccauggagcggaacgccggcagcgggaucaucaucuccgacacccccgugcacaacugcaacacgaccugccagaccccgaagggcgccaucaacaccucgcugcccuuccagaacauccaccccaucaccaucggcaagugccccaaguacgugaaguccaccaagcugcgccucgcgacggggcugcggaacgucccgagcauccagucccgcggccuguucggggccaucgccggcuucaucgagggcggguggaccggcaugguggacgggugguacggcuaccaccaccagaacgagcaggggucgggcuacgccgccgaccucaaguccacccagaacgcgaucgacgagaucaccaacaaggugaacagcgucaucgagaagaugaacacgcaguucaccgccguggggaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaacgugaagaaccucuacgagaagguccggucgcagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgcgaggagaucgacggggugaagcucgaguccacccggaucuaccagauccuggcgaucuacucgaccgucgccuccagccuggugcucguggucucgcugggcgccaucuccuucuggaugugcagcaacgggucccugcagugccgcaucugcaucuga

SEQ ID NO: 6441 - RNA, 1701 nt, Artificial Sequence
  derived and/or modified CDS sequence (AUadapt) from InfluenzaA__ADO84715__HA
augaaggccauccuggugguccuccuguacaccuucgccaccgcgaacgccggcacgcugugcaucggguaccacgccaacaacucgaccgacaccguggacaccgugcucgagaagaacgucacggugacccacuccgugaaccugcuggaggacaagcacaacggcaagcucugcaagcugcgcggggucgcgccccugcaccucggcaagugcaacaucgccggguggauccugggcaacccggagugcgagagccuguccaccgcgucguccuggagcuacaucguggagaccuucuccucggacaacggcacgugcuaccccggggacuucaucgacuacgaggagcuccgggagcagcuguccagcguguccucguucgagcgcuucgagaucuuccccaagaccuccagcuggcccaaccacgacuccaacaagggcgucaccgccgccugcccgcacgccggggccaagucguucuacaagaaccugaucuggcucgugaagaagggcaacuccuaccccaagcugagcaaguccuacaucaacgacaaggggaaggaggugcugguccucuggggcauccaccaccccucgaccagcgccgaccagcagucccuguaccagaacgccgacgccuacguguucgugggcacgagccgguacuccaagaaguucaagcccgagaucgccauccgcccgaagguccgggaccaggaggggcgcaugaacuacuacuggacccugguggagcccggcgacaagaucaccuucgaggcgaccgggaaccucguggucccccgguacgccuucgccauggagcgcaacgccggcucgggcaucaucaucuccgacacgcccgugcacgacugcaacacgaccugccagaccccgaagggggccaucaacaccagccugcccuuccagaacauccaccccaucaccaucggcaagugccccaaguacgugaaguccaccaagcugcggcucgcgaccgggcugcgcaacgucccgucgauccagucccggggccuguucggggccaucgccggcuucaucgagggcggguggacgggcaugguggacgggugguacggcuaccaccaccagaacgagcaggggagcggcuacgccgccgaccucaaguccacccagaacgcgaucgacgagaucaccaacaaggugaacucggucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacuccaacgugaagaaccucuacgagaagguccgcagccagcugaagaacaacgccaaggagaucggcaacgggugcuucgaguucuaccacaagugcgacaacacgugcauggaguccgugaagaacggcaccuacgacuaccccaaguacucggaggaggccaagcugaaccgggaggagaucgacggggugaagcucgaguccacccgcaucuaccagauccuggcgaucuacagcaccgucgccuccucgcuggugcucguggucagccugggcgccaucuccuucuggaugugcagcaacggcucccugcagugccggaucugcaucuga

SEQ ID NO: 6442 - RNA, 1701 nt, Artificial Sequence; identical to SEQ ID NO: 96
  derived and/or modified CDS sequence (AUadapt) from InfluenzaA__ADP95341__HA

SEQ ID NO: 6443 - RNA, 1701 nt, Artificial Sequence; identical to SEQ ID NO: 62
  derived and/or modified CDS sequence (AUadapt) from InfluenzaA__ADP95351__HA

SEQ ID NO: 6444 - RNA, 1701 nt, Artificial Sequence; identical to SEQ ID NO: 62
  derived and/or modified CDS sequence (AUadapt) from InfluenzaA__ADP95361__HA

SEQ ID NO: 6445 - RNA, 1701 nt, Artificial Sequence; identical to SEQ ID NO: 62
  derived and/or modified CDS sequence (AUadapt) from InfluenzaA__ADP95371__HA

SEQ ID NO: 6446 - RNA, 1701 nt, Artificial Sequence; identical to SEQ ID NO: 62
  derived and/or modified CDS sequence (AUadapt) from InfluenzaA__ADP95381__HA

SEQ ID NO: 6447 - RNA, 1701 nt, Artificial Sequence; identical to SEQ ID NO: 62
  derived and/or modified CDS sequence (AUadapt) from InfluenzaA__ADP95391__HA

SEQ ID NO: 6448 - RNA, 1701 nt, Artificial Sequence; identical to SEQ ID NO: 3156
  derived and/or modified CDS sequence (AUadapt) from InfluenzaA__ADQ28007__HA

SEQ ID NO: 6449 - RNA, 1701 nt, Artificial Sequence; identical to SEQ ID NO: 116
  derived and/or modified CDS sequence (AUadapt) from InfluenzaA__ADQ28008__HA

SEQ ID NO: 6450 - RNA, 1701 nt, Artificial Sequence; identical to SEQ ID NO: 4765
  derived and/or modified CDS sequence (AUadapt) from InfluenzaA__ADQ28009__HA

SEQ ID NO: 6451 - RNA, 1701 nt, Artificial Sequence
  derived and/or modified CDS sequence (AUadapt) from InfluenzaA__ADQ28010__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucaacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagagccugaucuggcucgugaagaaggggaacuccuaccccaagcugucgaagagcuacaucaacgacaagggcaaggaggugcugguccucugggggauccaccaccccuccaccucggccgaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggucgggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgcgaccggccugcgcaacgucccgucgauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacucggucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 6452 - RNA, 1701 nt, Artificial Sequence; identical to SEQ ID NO: 116
  derived and/or modified CDS sequence (AUadapt) from InfluenzaA__ADQ28011__HA

SEQ ID NO: 6453 - RNA, 1701 nt, Artificial Sequence; identical to SEQ ID NO: 116
  derived and/or modified CDS sequence (AUadapt) from InfluenzaA__ADQ28012__HA

SEQ ID NO: 6454 - RNA, 1701 nt, Artificial Sequence; identical to SEQ ID NO: 116
  derived and/or modified CDS sequence (AUadapt) from InfluenzaA__ADQ28013__HA

SEQ ID NO: 6455 - RNA, 1701 nt, Artificial Sequence; identical to SEQ ID NO: 3156
  derived and/or modified CDS sequence (AUadapt) from InfluenzaA__ADQ28014__HA

SEQ ID NO: 6456 - RNA, 1701 nt, Artificial Sequence; identical to SEQ ID NO: 3156
  derived and/or modified CDS sequence (AUadapt) from InfluenzaA__ADQ28015__HA

SEQ ID NO: 6457 - RNA, 1701 nt, Artificial Sequence; identical to SEQ ID NO: 116
  derived and/or modified CDS sequence (AUadapt) from InfluenzaA__ADQ28016__HA

SEQ ID NO: 6458 - RNA, 1701 nt, Artificial Sequence; identical to SEQ ID NO: 116
  derived and/or modified CDS sequence (AUadapt) from InfluenzaA__ADQ28017__HA

SEQ ID NO: 6459 - RNA, 1701 nt, Artificial Sequence; identical to SEQ ID NO: 5160
  derived and/or modified CDS sequence (AUadapt) from InfluenzaA__ADQ28018__HA

SEQ ID NO: 6460 - RNA, 1701 nt, Artificial Sequence; identical to SEQ ID NO: 3156
  derived and/or modified CDS sequence (AUadapt) from InfluenzaA__ADQ28019__HA

SEQ ID NO: 6461 - RNA, 1701 nt, Artificial Sequence
  derived and/or modified CDS sequence (AUadapt) from InfluenzaA__ADQ28020__HA
auggaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcaggccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccacaacauccaccccaucacgaucgggaagugccccaaguacgugaaguccaccaagcugcggcucgcgaccggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 6462 - RNA, 1701 nt, Artificial Sequence; identical to SEQ ID NO: 4108
  derived and/or modified CDS sequence (AUadapt) from InfluenzaA__ADQ28021__HA

SEQ ID NO: 6463 - RNA, 1701 nt, Artificial Sequence
  derived and/or modified CDS sequence (AUadapt) from InfluenzaA__ADQ28022__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcaacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccggggccaggaggggcgcaugaacuacuacuggacccugguggagcccggcgacaagaucaccuucgaggcgaccgggaaccucguggucccccgguacgccuucgccauggagcgcaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagucgaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcucgagagcacccgcaucuaccagauccuggcgaucuacuccaccgucgccucgagccuggugcucguggucucccugggcgccaucucguucuggaugugcuccaacggcagccugcagugccggaucugcaucuga

SEQ ID NO: 6464 - RNA, 1701 nt, Artificial Sequence; identical to SEQ ID NO: 116
  derived and/or modified CDS sequence (AUadapt) from InfluenzaA__ADQ28023__HA

SEQ ID NO: 6465 - RNA, 1701 nt, Artificial Sequence; identical to SEQ ID NO: 3156
  derived and/or modified CDS sequence (AUadapt) from InfluenzaA__ADQ28024__HA

SEQ ID NO: 6466 - RNA, 1701 nt, Artificial Sequence; identical to SEQ ID NO: 3156
  derived and/or modified CDS sequence (AUadapt) from InfluenzaA__ADQ28025__HA

SEQ ID NO: 6467 - RNA, 1701 nt, Artificial Sequence; identical to SEQ ID NO: 3659
  derived and/or modified CDS sequence (AUadapt) from InfluenzaA__ADQ28028__HA

SEQ ID NO: 6468 - RNA, 1701 nt, Artificial Sequence; identical to SEQ ID NO: 5139
  derived and/or modified CDS sequence (AUadapt) from InfluenzaA__ADQ28029__HA

SEQ ID NO: 6469 - RNA, 1701 nt, Artificial Sequence
  derived and/or modified CDS sequence (AUadapt) from InfluenzaA__ADQ28030__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacagcaacaaggggaucaccgccgccugcccgcacgccggcgcgaaguccuucuacaagaaccugaucuggcucgucaagaaggggaacucguaccccaagcuguccaagagcuacaucaacgacaagggcaaggaggugcuggugcucugggggauccaccaccccucgaccuccgccgaccagcagagccuguaccagaacgccgacgccuacgucuucgugggcacgucccgguacucgaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgagccugguccucguggugucccugggggccaucucguucuggaugugcuccaacggcagccugcagugccggaucugcaucuga

SEQ ID NO: 6470 - RNA, 1701 nt, Artificial Sequence; identical to SEQ ID NO: 4108
  derived and/or modified CDS sequence (AUadapt) from InfluenzaA__ADQ28031__HA

SEQ ID NO: 6471 - RNA, 1701 nt, Artificial Sequence; identical to SEQ ID NO: 3156
  derived and/or modified CDS sequence (AUadapt) from InfluenzaA__ADQ28032__HA

SEQ ID NO: 6472 - RNA, 1701 nt, Artificial Sequence
  derived and/or modified CDS sequence (AUadapt) from InfluenzaA__ADQ28034__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccggggccaggaggggcgcaugaacuacuacuggaccaucguggagcccggcgacaagaucaccuucgaggcgaccgggaaccugguggucccccgguacgccuucgccauggagcgcaacgccggcuccggcaucaucaucagcgacacgcccgugcacgacugcaacacgaccugccagaccccgaagggggccaucaacaccucccuccccuuccagaacauccaccccaucaccaucggcaagugccccaaguacgucaagucgaccaagcugcggcuggcgaccgggcuccgcaacgugccguccauccagagccggggccuguucggggccaucgccggcuucaucgagggcggguggacgggcaugguggacgggugguacggcuaccaccaccagaacgagcagggguccggcuacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaaccggaaggucgacgacggguuccuggacaucuggaccuacaacgccgagcuccuggugcugcucgagaacgagcgcacccuggacuaccacgacagcaacgugaagaaccuguacgagaagguccggucccagcucaagaacaacgccaaggagaucggcaacgggugcuucgaguucuaccacaagugcgacaacacgugcauggagucggugaagaacggcaccuacgacuaccccaaguacuccgaggaggccaagcugaaccgcgaggagaucgacggggugaagcuggagagcacccggaucuaccagauccucgcgaucuacuccaccgucgccucgagccuggugcugguggucucccucggcgccaucucguucuggaugugcuccaacggcagccugcagugccgcaucugcaucuga

SEQ ID NO: 6473 - RNA, 1701 nt, Artificial Sequence
  derived and/or modified CDS sequence (AUadapt) from InfluenzaA__ADQ28035__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugccgccugcggggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgcgagcagcugucguccgugagcuccuucgagcgguucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgcuacucgaagaaguucaagcccgagaucgccauccggccgaagguccgcggccaggaggggcggaugaacuacuacuggacccugguggagcccggcgacaagaucaccuucgaggcgaccgggaaccucguggucccccgcuacgccuucgccauggagcggaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagucgaccaagcugcgccucgcgaccgggcugcggaacgugccguccauccagagccgcggccuguucggggccaucgccggcuucaucgagggcggguggacgggcaugguggacgggugguacggcuaccaccaccagaacgagcagggguccggcuacgccgccgaccucaagucgacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggguuccucgacaucuggaccuacaacgccgagcugcuggugcuccuggagaacgagcgcacccuggacuaccacgacagcaacgugaagaaccucuacgagaagguccggucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgcgaggagaucgacggggugaagcucgagagcacccggaucuaccagauccuggcgaucuacuccaccgucgccucgagccuggugcucguggucucccugggcgccaucucguucuggaugugcuccaacggcagccugcagugccgcaucugcaucuga

SEQ ID NO: 6474 - RNA, 1701 nt, Artificial Sequence; identical to SEQ ID NO: 116
  derived and/or modified CDS sequence (AUadapt) from InfluenzaA__ADQ28036__HA

SEQ ID NO: 6475 - RNA, 1701 nt, Artificial Sequence; identical to SEQ ID NO: 116
  derived and/or modified CDS sequence (AUadapt) from InfluenzaA__ADQ28037__HA

SEQ ID NO: 6476 - RNA, 1701 nt, Artificial Sequence; identical to SEQ ID NO: 3156
  derived and/or modified CDS sequence (AUadapt) from InfluenzaA__ADQ28038__HA

SEQ ID NO: 6477 - RNA, 1701 nt, Artificial Sequence; identical to SEQ ID NO: 116
  derived and/or modified CDS sequence (AUadapt) from InfluenzaA__ADQ28039__HA

SEQ ID NO: 6478 - RNA, 1701 nt, Artificial Sequence; identical to SEQ ID NO: 3156
  derived and/or modified CDS sequence (AUadapt) from InfluenzaA__ADQ28040__HA

SEQ ID NO: 6479 - RNA, 1701 nt, Artificial Sequence; identical to SEQ ID NO: 3156
  derived and/or modified CDS sequence (AUadapt) from InfluenzaA__ADQ28041__HA

SEQ ID NO: 6480 - RNA, 1701 nt, Artificial Sequence
  derived and/or modified CDS sequence (AUadapt) from InfluenzaA__ADQ28043__HA
auggaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgacggcgccaaguccuucuacaagaaccugaucuggcucgugaagaaggggaacagcuaccccaagcuguccaagucguacaucaacgacaagggcaaggaggugcugguccucugggggauccaccaccccagcaccuccgcggaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggccaccggcaaccucguggucccccgguacgcguucgccauggagcgcaacgccgggucgggcaucaucaucuccgacacccccgugcacgacugcaacacgaccugccagaccccgaagggcgccaucaacaccagccugcccuuccacaacauccaccccaucacgaucgggaagugccccaaguacgugaaguccaccaagcugcggcucgccaccggccugcgcaacgucccgucgauccagucccgggggcuguucggcgcgaucgccggguucaucgagggcggcuggaccgggaugguggacggcugguacggguaccaccaccagaacgagcagggcagcggguacgccgccgaccucaaguccacgcagaacgccaucgacgagaucaccaacaaggugaacucggucaucgagaagaugaacacccaguucaccgcggugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggccaucuacagcaccgucgcgucgucccuggugcucguggucagccugggggccaucuccuucuggaugugcagcaacggcucccugcagugccggaucugcaucuga

SEQ ID NO: 6481 - RNA, 1701 nt, Artificial Sequence; identical to SEQ ID NO: 3156
  derived and/or modified CDS sequence (AUadapt) from InfluenzaA__ADQ28044__HA

SEQ ID NO: 6482 - RNA, 1701 nt, Artificial Sequence
  derived and/or modified CDS sequence (AUadapt) from InfluenzaA__ADQ28045__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcucccacgccggcgccaagucguucuacaagaaccugaucuggcucgugaagaaggggaacuccuacccgaagcugagcaagucguacaucaacgacaagggcaaggaggugcugguccucugggggauccaccaccccuccaccagcgccgaccagcagucccuguaccagaacgccgacgccuacguguucgugggcacgucgcgguacuccaagaaguucaagcccgagaucgccauccgccccaagguccgggaccaggagggccgcaugaacuacuacuggacccugguggagccgggggacaagaucaccuucgaggcgaccggcaaccucguggucccccgguacgccuucgccauggagcgcaacgccgggagcggcaucaucaucuccgacacgcccgugcacgacugcaacacgaccugccagacccccaagggcgccaucaacaccucgcugccguuccagaacauccaccccaucaccaucgggaagugccccaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcucgggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagucggugaagaacgggaccuacgacuacccgaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 6483 - RNA, 1701 nt, Artificial Sequence; identical to SEQ ID NO: 3384
  derived and/or modified CDS sequence (AUadapt) from InfluenzaA__ADQ28047__HA

SEQ ID NO: 6484 - RNA, 1701 nt, Artificial Sequence; identical to SEQ ID NO: 116
  derived and/or modified CDS sequence (AUadapt) from InfluenzaA__ADQ28048__HA

SEQ ID NO: 6485 - RNA, 1701 nt, Artificial Sequence; identical to SEQ ID NO: 3156
  derived and/or modified CDS sequence (AUadapt) from InfluenzaA__ADQ28049__HA

SEQ ID NO: 6486 - RNA, 1701 nt, Artificial Sequence; identical to SEQ ID NO: 116
  derived and/or modified CDS sequence (AUadapt) from InfluenzaA__ADQ28050__HA

SEQ ID NO: 6487 - RNA, 1701 nt, Artificial Sequence
  derived and/or modified CDS sequence (AUadapt) from InfluenzaA__ADQ28051__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacgacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 6488 - RNA, 1701 nt, Artificial Sequence; identical to SEQ ID NO: 116
  derived and/or modified CDS sequence (AUadapt) from InfluenzaA__ADQ28053__HA

SEQ ID NO: 6489 - RNA, 1701 nt, Artificial Sequence; identical to SEQ ID NO: 3156
  derived and/or modified CDS sequence (AUadapt) from InfluenzaA__ADQ28055__HA

SEQ ID NO: 6490 - RNA, 1701 nt, Artificial Sequence
  derived and/or modified CDS sequence (AUadapt) from InfluenzaA__ADQ28056__HA
auggaggccauccuggugguccuccuguacaccuucgccaccgcggacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccacaacauccaccccaucacgaucgggaagugccccaaguacgugaaguccaccaagcugcggcucgcgaccggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 6491 - RNA, 1701 nt, Artificial Sequence; identical to SEQ ID NO: 116
  derived and/or modified CDS sequence (AUadapt) from InfluenzaA__ADQ28057__HA

SEQ ID NO: 6492 - RNA, 1701 nt, Artificial Sequence; identical to SEQ ID NO: 116
  derived and/or modified CDS sequence (AUadapt) from InfluenzaA__ADQ28058__HA

SEQ ID NO: 6493 - RNA, 1701 nt, Artificial Sequence
  derived and/or modified CDS sequence (AUadapt) from InfluenzaA__ADQ28059__HA
augaaggccauccuggugguccuccuguacacccuggccaccgcgaacgccgacacgcucugcaucggcuaccacgccaacaacucgaccgacaccguggacaccgugcuggagaagaacgucacggugacccacuccgugaaccugcucgaggacaagcacaacgggaagcugugcaagcugcgcggcgucgcgccccuccaccuggggaagugcaacaucgccggcuggauccuggggaacccggagugcgagucgcucuccaccgccagcuccuggucguacaucguggagaccuccagcuccgacaacggcacgugcuaccccggcgacuucaucgacuacgaggagcugcgggagcagcugucguccgugagcuccuucgagcgcuucgagaucuuccccaagaccucguccuggcccaaccacgacucgaacaagggggucaccgccgccugcccgcacgccggcgcgaaguccuucuacaagaaccucaucuggcuggugaagaaggggaacagcuaccccaagcuguccaagucguacaucaacgacaagggcaaggaggugcucguccugugggggauccaccaccccagcaccuccgccgaccagcagucgcuguaccagaacgccgacgccuacguguucgugggcacguccaaguacagcaagaaguucaagcccgagaucgccauccggccgaagguccgcgaccaggagggccggaugaacuacuacuggacccucguggagcccggggacaagaucaccuucgaggcgaccggcaaccugguggucccccgcuacgccuucgccauggagcggaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcuccgccuggcgaccggccugcggaacgugccguccauccagucgcgcgggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcggaucgagaaccucaacaagaaggucgacgacggcuuccuggacaucuggaccuacaacgccgagcugcucgugcugcuggagaacgagcgcacccucgacuaccacgacagcaacgugaagaaccuguacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcucaaccgcgaggagaucgacggcgugaagcuggagagcacccggaucuaccagauccuggcgaucuacuccaccgucgccucgagccucgugcugguggucucccugggggccaucucguucuggaugugcuccaacggcagccuccagugccgcaucugcaucuga

SEQ ID NO: 6494 - RNA, 1701 nt, Artificial Sequence; identical to SEQ ID NO: 116
  derived and/or modified CDS sequence (AUadapt) from InfluenzaA__ADQ28060__HA

SEQ ID NO: 6495 - RNA, 1701 nt, Artificial Sequence
  derived and/or modified CDS sequence (AUadapt) from InfluenzaA__ADQ28061__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggcggugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgcgagcagcugucguccgugagcuccuucgagcgguucgagaucuuccccaagaccucguccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccaacguguucgugggcacgucccgcuacagcaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagucgcgcgggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggcgaucuacuccaccgucgccucgagccuggugcucguggucucccugggggccaucucguucuggaugugcuccaacggcagccugcagugccgcaucugcaucuga

SEQ ID NO: 6496 - RNA, 1701 nt, Artificial Sequence
  derived and/or modified CDS sequence (AUadapt) from InfluenzaA__ADQ28063__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccggaaccaggagggccgcaugaacuaccacuggacccuggugaagcccggggacaagaucaccuucgaggcgaccggcaaccucguggucccccgguacgccuucgccguggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggucaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgucaagcucgagagcacccgcaucuaccagauccuggcgaucuacuccaccguggccucgagccuggugcucgucgugucccugggggccaucucguucuggaugugcuccaacggcagccugcagugccggaucugcaucuga

SEQ ID NO: 6497 - RNA, 1701 nt, Artificial Sequence; identical to SEQ ID NO: 3662
  derived and/or modified CDS sequence (AUadapt) from InfluenzaA__ADQ28064__HA

SEQ ID NO: 6498 - RNA, 1701 nt, Artificial Sequence
  derived and/or modified CDS sequence (AUadapt) from InfluenzaA__ADQ28065__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccggccagcagagccuguaccagaacgccgacgccuacguguucgugggcacgucccgguacucgaagaaguucaagcccgagaucgccauccgcccgaagguccgggaccaggaggggcgcaugaacuacuacuggacccugguggagcccggcgacaagaucaccuucgaggcgaccgggaaccucguggucccccgguacgccuucgccauggagcgcaacgccggcuccggcaucaucaucagcgacacccaggugcacgacugcaacacgaccugccagacccccaagggggccaucaacacgucccugccguuccagaacauccaccccaucaccaucggcaagugccccaaguacgucaagucgaccaagcugcggcucgcgaccgggcugcgcaacgugcccuccauccagagccggggccuguucggggccaucgccggcuucaucgagggcggguggacgggcaugguggacgggugguacggcuaccaccaccagaacgagcagggguccggcuacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagucggugaagaacggcaccuacgacuacccgaaguacuccgaggaggccaagcugaaccgggaggagaucgacggggugaagcucgagagcacccgcaucuaccagauccuggcgaucuacuccaccgucgccucgagccuggugcucguggucucccugggcgccaucucguucuggaugugcuccaacggcagccugcagugccggaucugcaucuga

SEQ ID NO: 6499 - RNA, 1701 nt, Artificial Sequence
  derived and/or modified CDS sequence (AUadapt) from InfluenzaA__ADQ28066__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgcggguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggcgaucuacuccaccgucgccucgagccuggugcucguggucucccugggggccaucucguucuggaugugcuccaacggcagccugcagugccgcaucugcaucuga

SEQ ID NO: 6500 - RNA, 1701 nt, Artificial Sequence
  derived and/or modified CDS sequence (AUadapt) from InfluenzaA__ADQ28067__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucaacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 6501 - RNA, 1701 nt, Artificial Sequence
  derived and/or modified CDS sequence (AUadapt) from InfluenzaA__ADQ28068__HA
augaaggccauccuggugguccuccuguacaccuucaccacggccaacgcggacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagacguccagcuccgacaacgggaccugcuaccccggcgacuucaucaacuacgaggagcuccgggagcagcugucguccgugagcuccuucgagcgcuucgagaucuuccccaagaccucguccuggcccaaccacgacucgaacaagggcgucaccgccgccugcccgcacgccggcgagaaguccuucuacaagaaccugaucuggcucgugaagaaggggaacagcuaccccaagcuguccaagucguacaucaacgacaagggcaaggaggugcugguccucugggggauccaccaccccagcacguccgccgaccagcagucgcuguaccagaacgcggacgccuacguguucgugggcaccucccgguacagcaagaaguucaagcccgagaucgccauccgcccgaagguccgggaccaggagggccgcaugaacuaccacuggacccuggugaagcccggggacaagaucaccuucgaggccacgggcaaccucguggucccccgguacgccuucgcgauggagcgcaacgccggguccggcaucaucaucucggacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagucgcgggggcuguucggcgccaucgcgggguucaucgagggcggcuggaccgggaugguggacggcugguacggguaccaccaccagaacgagcagggcuccggguacgccgccgaccucaagucgacccagaacgccaucgacgagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggccaucuacuccaccgucgccucgagccuggugcucguggucucccugggggcgaucucguucuggaugugcuccaacggcagccugcagugccggaucugcaucuga

SEQ ID NO: 6502 - RNA, 1701 nt, Artificial Sequence; identical to SEQ ID NO: 6500
  derived and/or modified CDS sequence (AUadapt) from InfluenzaA__ADQ28069__HA

SEQ ID NO: 6503 - RNA, 1701 nt, Artificial Sequence
  derived and/or modified CDS sequence (AUadapt) from InfluenzaA__ADQ28070__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgagaagguccgccggcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgugaagcucgaguccacccggaucuaccagauccuggcgaucuacucgaccgucgccuccagccuggugcucguggucucgcugggggccaucuccuucuggaugugcagcaacggcucccugcagugccgcaucugcaucuga

SEQ ID NO: 6504 - RNA, 1701 nt, Artificial Sequence
  derived and/or modified CDS sequence (AUadapt) from InfluenzaA__ADQ28071__HA
augaaggccauccuggugguccuccuguacacccuggccaccgcgaacgccgacacgcucugcaucggcuaccacgccaacaacucgaccgacaccguggacaccgugcuggagaagaacgucacggugacccacuccgugaaccugcucgaggacaagcacaacgggaagcugugcaagcugcgcggcgucgcgccccuccaccuggggaagugcaacaucgccggcuggauccuggggaacccggagugcgagucgcucuccaccgccagcuccuggucguacaucguggagaccuccagcuccgacaacggcacgugcuaccccggcgacuucaucgacuacgaggagcugcgggagcagcugucguccgugagcuccuucgagcgcuucgagaucuuccccaagaccucguccuggcccaaccacgacucgaacaagggggucaccgccgccugcccgcacgccggcgcgaaguccuucuacaagaaccucaucuggcuggugaagaaggggaacagcuaccccaagcuguccaagucguacaucaacgacaagggcaaggaggugcucguccugugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccucguggagcccggggacaagaucaccuucgaggcgaccggcaaccugguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcuccggcuggcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacagcaacgugaagaaccuguacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcucaaccgggaggagaucgacggcgugaagcuggagagcacccgcaucuaccagauccuggcgaucuacuccaccgucgccucgagccucgugcugguggucucccugggggccaucucguucuggaugugcuccaacggcagccuccagugccggaucugcaucuga

SEQ ID NO: 6505 - RNA, 1701 nt, Artificial Sequence; identical to SEQ ID NO: 3858
  derived and/or modified CDS sequence (AUadapt) from InfluenzaA__ADR32361__HA

SEQ ID NO: 6506 - RNA, 1689 nt, Artificial Sequence
  derived and/or modified CDS sequence (AUadapt) from InfluenzaA__ADT78887__HA
auggcccugaucuaccucauccugcuguucaccucggugcgcggcgaccagaucugcaucggguaccacgccaacaacuccaccgagaaggucgacacgauccucgagcggaacgugaccgugacccacgcgaaggacauccuggagaagacccacaacggcaagcugugcaagcucaacgggaucccgccccuggagcugggcgacugcucgaucgccggguggcuccugggcaaccccgagugcgaccgccugcuccggguccccgagugguccuacaucauggagaaggagaaccccaaguacagccugugcuacccgggcuccuucaacgacuacgaggagcugaagcaccucaucucguccgugaagcacuucgagaaggugaagauccugcccaaggacggguggacgcagcacaccaccaccggcgggucgcgcgccugcgccgucuccggcaaccccagcuucuuccggaacaugguguggcugacgaagaaggggcccaacuacccgguggccaagggcuccuacaacaacaccucgggcgagcagaugcucaucaucuggggcguccaccaccccaacgacgaggcggagcagcgcgcccuguaccagaagguggggaccuacguguccgccucgaccuccacgcugaacaagcggagcacccccgagaucgccgcgcgccccgaggucaacgggcucggcucccggauggaguucucguggacccugcuggacaugugggacaccaucaacuucgaguccacgggcaaccucguggccccggaguacggguucaagaucucgaagcgcggcagcuccggggugaugaagaccgagggcacccuggagaacugcgagaccaagugccagacgccccugggggccaucaacaccacccuccccuuccacaacguccacccccugaccaucggcgagugcccgaaguacgucaagucggagaagcuggugcucgccacgggccugcggaacgugccccagaucgagucccgcgggcuguucggcgccaucgcgggguucaucgagggcggguggcagggcaugguggacggcugguacggguaccaccacucgaacgaccagggcuccggguacgccgccgacaaggagagcacccagaaggccuucgacggcaucaccaacaaggugaacuccgucaucgagaagaugaacacccaguucgaggccguggggaaggaguucucgaaccucgagaagcggcuggagaaccugaacaagaagauggaggacggcuuccucgacguguggacguacaacgcggagcugcugguccucauggagaacgagcgcacccuggacuuccacgacuccaacgugaagaaccuguacgacaagguccggaugcagcuccgcgacaacgugaaggagcugggcaacgggugcuucgaguucuaccacaagugcgacgacgagugcauggacucggugaagaacggcaccuacgacuaccccaaguacgaggaggaguccaagcugaaccggaacgagaucaagggggucaagcucagcuccaugggcguguaccagauccuggccaucuacgccaccguggccggcucgcugucccucgccaucaugauggcggggaucucguucuggaugugcuccaacggcagccugcagugccgcaucugcaucuga

SEQ ID NO: 6507 - RNA, 1701 nt, Artificial Sequence
  derived and/or modified CDS sequence (AUadapt) from InfluenzaA__ADT78908__HA
augaaggccaagcugcucauccugcugugcgcccucucggcgaccgacgccgacaccaucugcaucggcuaccacgccaacaacuccacggacaccguggacaccguccuggagaagaacgugaccgugacgcacucggucaaccugcucgaggacucccacaacgggaagcugugccgccugaagggcaaggcgccccuccagcuggggaagugcaacaucgccggcugggugcuggggaacccggagugcgagucgcuccuguccaaccggagcugguccuacaucgccgagacccccaacucggagaacgggaccugcuaccccggcgacuucgccgacuacgaggagcugcgcgagcagcucuccucgguguccagcuucgagcgguucgagaucuuccccaaggagcgcuccuggccgaagcacaacaccacgcgcggggucaccgccgccugcucgcacgcgcggaaguccucguucuacaagaaccugguguggcugaccgaggccaacggcuccuaccccaaccucagcaaguccuacgugaacaaccaggagaaggagguccuggugcuguggggcgugcaccaccccucgaacaucgaggaccagcggacccucuaccgcaaggacaacgccuacgucucggugguguccagcaacuacaaccggcgcuucacgcccgagaucgccaagcggccgaagguccgcgaccagcccggccggaugaacuacuacuggacccugcuggagcccggggacaccaucaucuucgaggccaccggcaaccucaucgcgcccugguacgccuucgcccugucccgcggcccggggucgggcaucaucacguccaacgcccccauggacgagugcgacaccaagugccagacgccccagggggccaucaacucgucccugcccuuccagaacauccacccggugaccaucggcgagugccccaaguacgugcggagcaccaagcuccgcauggucaccggccugcggaacauccccuccauccagucgcgcgggcuguucggcgcgaucgccggguucaucgagggcggguggaccggcaugauggacggcugguacggguaccaccaccagaacgagcagggcuccggguacgccgccgaccagaaguccacccagaacgccaucaacggcaucacgaacaaggugaacucggugaucgagaagaugaacacccaguucaccgcggucgggaaggaguucaacaagcucgagaagcggauggagaaccugaacaagaagguggacgacggcuuccuggacaucuggaccuacaacgccgagcuccuggugcugcucgagaacgagcgcacgcuggacuuccacgacagcaacgucaagaaccuguacgagaaggugaagaaccagcuccggaacaacgccaaggagcugggcaacgggugcuucgaguucuaccacaagugcgacaacgagugcauggaguccgucaagaacggcaccuacgacuaccccaaguacucggaggaguccaagcugaaccgcgagaagaucgacggggugaagcucgagucgaugggcguguaccgcauccuggccaucuacuccaccgucgccagcucgcuggugcuccuggugucccugggggcgaucucguucuggaugugcuccaacggcagccuccagugccggaucugcaucuga

SEQ ID NO: 6508 - RNA, 1701 nt, Artificial Sequence
  derived and/or modified CDS sequence (AUadapt) from InfluenzaA__ADT78929__HA
augaaggccaagcugcucauccugcugugcgcccucucggcgaccgacgccgacaccaucugcaucggcuaccacgccaacaacuccacggacaccguggacaccguccuggagaagaacgugaccgugacgcacucggucaaccugcucgaggacucccacaacgggaagcugugccgccugaagggcaucgcgccccuccagcuggggaagugcaacaucgccggcuggauccuggggaacccggagugcgagagccuccuguccaagcggucgugguccuacaucgccgagacccccaacagcgagaacgggaccugcuaccccggcgacuucgccgacuacgaggagcugcgcgagcagcucuccucgguguccagcuucgagcgguucgagaucuuccccaaggagcgcuccuggccgaagcacaacaucacccggggcgugacggccgccugcucgcacgcgggcaaguccagcuucuacaagaaccugcuguggcucaccgagaccaagggguccuaccccaaccugucgaaguccuacgucaacaacaaggagaaggaggugcuggugcucuggggcguccaccaccccagcaacaucgaggaccagaagacccuguaccgcaaggagaacgccuacgugucgguggucuccagcaacuacaaccggcgcuucacgcccgagaucgccgagcggccgaaggugcgcgggcaggccggccggaugaacuacuacuggacccugcucgagcccggcgacaccaucaucuucgaggccaacgggaaccugaucgcgcccugguacgccuucgcccugucccgcggccucgggucgggcaucaucaccuccaacgccagcauggacgagugcgacacgaagugccagacgccccagggcgccaucaacuccucgcugccguuccagaacauccaccccgugaccaucggggagugccccaaguacgucaaguccaccaagcugcggauggugaccggccuccgcaacauccccagcauccagucccgggggcuguucggcgcgaucgccggguucaucgagggcggcuggaccgggaugaucgacggcugguacggguaccaccaccagaacgagcagggcucgggguacgccgccgaccagaaguccacccagaacgccaucaacggcaucaccaacaaggugaacagcgucaucgagaagaugaacacgcaguucaccgcggugggcaaggaguucaacaagcuggagaagcgcauggagaaccucaacaagaagguggacgacggguuccuggacaucuggaccuacaacgccgagcugcucguccugcuggagaacgagcggacccucgacuuccacgacuccaacgugaagaaccuguacgagaaggugaagaaccagcugcgcaacaacgccaaggagaucggcaacgggugcuucgaguucuaccacaagugcaacaacgagugcauggagucggucaagaacggcacguacgacuacccgaaguacuccgaggagagcaagcucaaccgggagaagaucgacggggugaagcuggaguccaugggcgucuaccagauccuggccaucuacucgaccguggccagcucccucgugcugcuggucucgcucggcgcgaucuccuucuggaugugcagcaacgggucccugcagugccgcaucugcaucuga

SEQ ID NO: 6509 - RNA, 1701 nt, Artificial Sequence
  derived and/or modified CDS sequence (AUadapt) from InfluenzaA__ADT78936__HA
augaaggccaagcugcucgugcugcugugcgcccucucggcgaccuacgccgacaccaucugcaucggcuaccacgccaacaacuccacggacaccgucgacaccgugcuggagaagaacgugaccgucacgcacucggugaaccugcucgaggacucccacaacgggaagcugugccgccugaagggcaaggcgccccuccagcuggggaagugcaacaucgccggcuggauccuggggaacccggagugcgagagccuccuguccaagcggucgugguccuacaucgccgagacccccaacagcgagaacgggaccugcuaccccggcgacuucgccgacuacgaggagcugcgcgagcagcucuccucgguguccagcuucgagcgguucgagaucuuccccaaggaguccucguggccgaagcacaacaccacgcgcggggucaccgccgccugcucccacgcgcgcaagagcuccuucuacaagaaccugcuguggcucaccgaggccaacggcucguaccccaaccuguccaagagcuacgugaacaaccaggagaaggaggugcugguccucuggggcgugcaccaccccucgaacaucgaggaccagcggacccuguaccggaaggagaacgccuacguguccgucgugagcuccaacuacaaccgccgguucacgcccgagaucgccgagcgcccgaaggugcggaaccaggccggccgcaugaacuacuacuggacccugcucgagcccggggacaccaucaucuucgaggcgaacggcaaccugaucgcccccugguacgccuucgcccugucgcggggccucggguccggcaucaucaccucgaacgccuccauggacgagugcgacacgaagugccagacgccccagggggcgaucaacagcucccugccguuccagaacauccaccccgucaccaucggcgagugccccaaguacgucaagucgaccaagcugcgcauggugaccggccuccggaacauccccuccauccagagccgcgggcuguucggcgccaucgccggguucaucgagggcggguggaccggcaugauggacggcugguacggguaccaccaccagaacgagcagggcuccggguacgccgccgaccagaaguccacccagaacgcgaucaacggcaucaccaacaaggugaacucggugaucgagaagaugaacacgcaguucaccgccguggggaaggaguucaacaagcuggagaagcggauggagaaccucaacaagaaggucgacgacggcuuccuggacaucuggaccuacaacgccgagcugcucgugcugcuggagaacgagcgcacccucgacuuccacgacagcaacgugaagaaccuguacgagaaggucaagaaccagcugcggaacaacgccaaggagcucggcaacgggugcuucgaguucuaccacaagugcgacaacgagugcauggaguccgugaagaacggcacguacgacuacccgaaguacucggaggaguccaagcugaaccgcgagaagaucgacggggucaagcuggagagcaugggcguguaccggauccucgccaucuacucgaccguggcguccagccugguccugcucgugucccugggggccaucucguucuggaugugcuccaacggcagccugcagugccgcaucugcaucuga

SEQ ID NO: 6510 - RNA, 1689 nt, Artificial Sequence
  derived and/or modified CDS sequence (AUadapt) from InfluenzaA__ADT78961__HA
auggccaucaucugccugauccuccuguucaccgccgugcgcggcgaccagaucugcaucggguaccacgcgaacaacucgaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugucgguccccgagugguccuacaucauggagaaggagaacccccgggacggccucugcuacccggggagcuucaacgacuacgaggagcugaagcaccuccuguccucggugaagcacuucgagaaggugaagauccugcccaagaaccgcuggacgcagcacaccaccaccggcgggucccgggccugcgccgucucgggcaaccccuccuucuuccgcaacaugguguggcugacgaagaaggggagcaacuaccccguggcgaagggcuccuacaacaacaccucgggcgagcagaugcucaucaucuggggcguccaccacccgaacgacgagaccgagcagcggacccuguaccagaacguggagacguacguguccgucucgaccuccacccugaacaagcgcagcacccccaagaucgccacgcggcccgaggugaacgggcucgggucccgcauggaguucucguggacccugcuggacaugugggacaccaucaacuucgaguccaccggcaaccucaucgcccccgaguacggcuucaagaucucgaagcgggggagcuccggcaucaugaagacggaggggacccuggagaacugcgagaccaagugccagaccccgcugggcgccaucaacacgacccuccccuuccacaacgugcacccccugaccaucggggagugccccaaguacgucaagucggagaagcuggugcucgcgaccggcccgcgcaacgugccccagaucgagucccggggccuguucggggccaucgccggcuucaucgagggcggguggcaggggauggucgacggcugguacggcuaccaccacucgaacgaccagggguccggcuacgccgccgacaaggagagcacgcagaaggcguucgacgggaucaccaacaaggugaacuccgugaucgagaagaugaacacccaguucgaggccgucggcaaggaguucucgaaccuggagcgccggcucgagaaccugaacaagaagauggaggacggguuccuggacguguggaccuacaacgccgagcuccuggugcugauggagaacgagcgcacgcucgacuuccacgacuccaacgucaagaaccuguacgacaaggugcggaugcagcugcgcgacaacgucaaggagcucggcaacggcugcuucgaguucuaccacaagugcgacgacgagugcaugaacucggugaagaacgggaccuacgacuaccccaaguacgaggaggaguccaagcugaaccggaacgagaucaagggcgugaagcugagcuccaugggggucuaccagauccucgugaucuacgccaccguggccggcucgcugucccuggcgaucaugauggccggcaucucguucuggaugugcuccaacgggagccuccagugccgcaucugcaucuga

SEQ ID NO: 6511 - RNA, 1701 nt, Artificial Sequence; identical to SEQ ID NO: 1009
  derived and/or modified CDS sequence (AUadapt) from InfluenzaA__ADT78971__HA

SEQ ID NO: 6512 - RNA, 1701 nt, Artificial Sequence; identical to SEQ ID NO: 550
  derived and/or modified CDS sequence (AUadapt) from InfluenzaA__ADT79010__HA

SEQ ID NO: 6513 - RNA, 1701 nt, Artificial Sequence; identical to SEQ ID NO: 1009
  derived and/or modified CDS sequence (AUadapt) from InfluenzaA__ADT79030__HA

SEQ ID NO: 6514 - RNA, 1701 nt, Artificial Sequence; identical to SEQ ID NO: 1587
  derived and/or modified CDS sequence (AUadapt) from InfluenzaA__ADT79050__HA

SEQ ID NO: 6515 - RNA, 1701 nt, Artificial Sequence
  derived and/or modified CDS sequence (AUadapt) from InfluenzaA__ADT79108__HA
augaaggcccgccugcucauccugcugugcgcccucucggcgaccgacgccgacaccaucugcaucggcuaccacgccaacaacuccacggacaccguggacaccguccuggagaagaacgugaccgugacgcacucggucaaccugcucgaggacucccacaacgggaagcugugccggcugaagggcaucgcgccccuccagcuggggaagugcaacaucgccggcuggauccuggggaacccggagugcgagagccuccuguccaaccgcucgugguccuacaucgccgagacccccaacagcgagaacgggaccugcuaccccggcgacuucgccgacuacgaggagcugcgggagcagcucuccucgguguccagcuucgagcgcuucgagaucuuccccaaggagcgguccuggccgaagcacaacaucacccgcggggugacggccgccugcucgcacgcgaagaaguccagcuucuacaagaaccugcuguggcucaccgaggccaacggcuccuaccccaaccugaucaagucguacgucaacaacaaggagaaggaggugcuggugcucuggggcguccaccaccccuccaacaucgaggaccagcggacccuguaccgcaaggagaacgccuacgugagcguggucucguccaacuacaaccggcgcuucacccccgagaucgccgagcggccgaaggugcgcggccaggccgggcggaugaacuacuacuggacgcugcucgagcccggcgacaagaucaucuucgaggcgaacggcaaccugaucgcccccugguacgccuucgcccugagccgcgggcucggcuccgggaucaucaccucgaacgccuccauggacgagugcgacaccaagugccagacgccccagggcgcgaucaacagcucccugccguuccagaacauccaccccgugaccaucggcgagugccccaaguacguccggucgaccaagcugcgcauggugaccgggcuccggaacauccccuccauccagagccgcggccuguucggggccaucgccggcuucaucgagggcggguggaccggcaugguggacgggugguacggcuaccaccaccagaacgagcagggguccggcuacgccgccgaccagaaguccacgcagaacgcgaucaacgggaucaccaacaaggucaacucggugaucgagaagaugaacacccaguucaccgccgugggcaaggaguucaacaagcuggagaagcggauggagaaccucaacaagaaggucgacgacggcuuccuggacaucuggacguacaacgccgagcugcucgugcugcuggagaacgagcgcacccucgacuuccacgacagcaacgugaagaaccuguacgagaaggucaagaaccagcugcggaacaacgccaaggagaucgggaacggcugcuucgaguucuaccacaagugcgacaacgagugcauggaguccgugaagaacgggaccuacgacuacccgaaguacucggaggaguccaagcucaaccgcgagaagaucgacggcgucaagcuggagagcauggggguguaccagauccuggccaucuacuccaccguggcgucgagccucguccugcuggugucccucggcgccaucucguucuggaugugcuccaacggcagccugcagugccgcaucugcaucuga

SEQ ID NO: 6516 - RNA, 1689 nt, Artificial Sequence
  derived and/or modified CDS sequence (AUadapt) from InfluenzaA__ADT79119__HA
auggccaucaucuaccugauccuccuguucaccgccgugcgcggcgaccagaucugcaucggguaccacgcgaacaacucgaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugucgguccccgagugguccuacaucauggagaaggagaacccccgggacggccucugcuacccggggucguucaacgacuacgaggagcugaagcaccuccuguccagcgugaagcacuucgagaaggugaagauccugcccaaggaccgcuggacgcagcacaccaccaccggcgggucccgggccugcgccgucucgggcaaccccuccuucuuccgcaacaugguguggcugacgaagaaggggucgaacuaccccguggcgaagggcuccuacaacaacaccucgggcgagcagaugcucaucaucuggggcguccaccacccgaacgacgagaccgagcagcggacccuguaccagaacguggggacguacguguccgucgggaccagcacccugaacaagcgcuccacccccgacaucgccacgcggcccaaggugaacggccucggcgggcgcauggaguucucguggacccugcuggacaugugggacaccaucaacuucgaguccaccggcaaccucaucgcccccgaguacggguucaagaucucgaagcggggcuccucggggaucaugaagacggagggcacccugggcaacugcgagaccaagugccagaccccgcugggggccaucaacacgacccuccccuuccacaacgugcacccccugaccaucggcgagugccccaaguacgucaagagcgagaagcuggugcucgcgaccgggcugcgcaacgugccgcagaucgagucccggggccuguucggggccaucgccggcuucaucgagggcggguggcagggcauggucgacgggugguacggcuaccaccacucgaacgaccagggguccggcuacgccgccgacaaggagucgacgcagaaggcguucgacggcaucaccaacaaggugaacuccgugaucgagaagaugaacacccaguucgaggccgucgggaaggaguucucgaaccucgagcgccggcuggagaaccugaacaagaagauggaggacggcuuccucgacguguggaccuacaacgccgagcugcuggugcucauggagaacgagcgcacgcuggacuuccacgacuccaacgucaagaaccuguacgacaaggugcggaugcagcuccgcgacaacgucaaggagcuggggaacggcugcuucgaguucuaccacaagugcgacgacgagugcaugaacagcgugaagaacggcaccuacgacuaccccaaguacgaggaggaguccaagcugaaccggaacgagaucaagggggugaagcucucguccaugggcgucuaccagauccuggccaucuacgccaccguggcggggucgcugucccucgccaucaugauggccggcaucucguucuggaugugcuccaacgggagccugcagugccgcaucugcaucuga

SEQ ID NO: 6517 - RNA, 1689 nt, Artificial Sequence
  derived and/or modified CDS sequence (AUadapt) from InfluenzaA__ADT79129__HA
auggccaucaucuaccugauccuccuguucaccgccgugcgcggcgaccagaucugcaucggguaccacgcgaacaacucgaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugcggguccccgaguggucguacaucauggagaaggagaacccccgcgacggccucugcuacccgggguccuucaacgacuacgaggagcugaagcaccuccugucguccgugaagcacuucgagaaggugaagauccugcccaaggaccgguggacgcagcacaccaccaccggcgggagccgcgccugcgccgucuccggcaaccccucguucuuccggaacaugaucuggcugacgaagaagggguccaacuaccccguggcgaagggcucguacaacaacaccuccggcgagcagaugcucaucaucuggggcgugcaccacccgaacgacgagaccgagcagcgcacccuguaccagaacgucgggacguacgugucgguggucaccuccacccugaacaagcggagcacccccaagaucgccacgcgccccaaggugaacgggcucggcggccggauggaguucuccuggacccugcuggacaugugggacaccaucaacuucgagucgaccgggaaccucaucgcccccgaguacggcuucaagaucuccaagcgcgggucguccggcaucaugaagacggaggggacccuggagaacugcgagaccaagugccagaccccgcugggcgccaucaacacgacccuccccuuccacaacgugcacccccuggcgaucggcgagugccccaaguacgucaagucggagaagcuggugcucgccaccgggcugcggaacgugccgcagaucgagagccgcggccuguucggggccaucgccggcuucaucgagggcggguggcagggcauggucgacgggugguacggcuaccaccacuccaacgaccaggggucgggcuacgccgcggacaaggaguccacccagcgggccuucgacgggaucacgaacaaggugaacucggugaucgagaagaugaacacccaguucgaggccgucggcaaggaguucuccaaccucgagcgccggcuggagaaccugaacaagaagauggaggacggcuuccucgacguguggaccuacaacgccgagcugcuggugcucauggagaacgagcgcacccuggacuuccacgacucgaacgucaagaaccuguacgacaaggugcggaugcagcuccgcgacaacgucaaggagcuggggaacggcugcuucgaguucuaccacaagugcgacgacgagugcaugaacuccgugaagaacgggacguacgacuaccccaaguacgaggaggagagcaagcugaaccggaacgagaucaagggcgugaagcucuccucgaugggcgucuaccagauccuggccaucuacgcgaccguggccgggucccugucgcucgccaucaugauggccggcaucuccuucuggaugugcagcaacgggucccugcagugccgcaucugcaucuga

SEQ ID NO: 6518 - RNA, 1701 nt, Artificial Sequence
  derived and/or modified CDS sequence (AUadapt) from InfluenzaA__ADT79232__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcuccucgcgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccucgcugcccuuccagaacaagcaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcucgggguacgccgccgacgugaaguccacgcagaacgcgaucgacgagaucaccaacaaggucaacagcgugaucgagaagaugaacacccaguucaccgccgucggcaaggaguucaaccaccucgagaagcgcaucgagaaccugaacaagaagguggacgacggcuuccuggacaucuggacguacaacgccgagcuccuggugcugcucgagaacgagcggacccuggacuaccacgacuccaacgucaagaaccuguacgagaaggugcgcucgcagcucaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgucaagcuggaguccacccgcaucuaccagauccucgcgaucuacucgaccguggccagcucccuggugcuggucgugucgcucggggccaucuccuucuggaugugcagcaacggcucccugcagugccggaucugcaucuga

SEQ ID NO: 6519 - RNA, 1701 nt, Artificial Sequence
  derived and/or modified CDS sequence (AUadapt) from InfluenzaA__ADT79242__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagacccccuccagcgacaacggcacgugcuaccccggcgacuucaucgacuacgaggagcuccgggagcagcuguccucgguguccagcuucgagcgcuucgagaucuuccccaagaccuccucguggccgaaccacgacuccaacaagggggucaccgccgccugcccccacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacguguucgugggcagcucccgguacucgaagaaguucaagccggagaucgccauccgccccaagguccgggaccaggagggccgcaugaacuacuacuggacgcugguggagcccggggacaagaucaccuucgaggcgaccggcaaccucguggucccccgguacgccuucgccauggagcgcaacgccggguccggcaucaucaucagcgacaccccggugcacgacugcaacacgaccugccagacccccaagggcgccaucaacaccucccugcccuuccagaacauccaccccaucacgaucgggaagugcccgaaguacgucaagucgaccaagcugcggcucgcgaccggccugcgcaacgugcccuccauccagagccgggggcuguucggcgccaucgccggguucaucgagggcggcuggaccgggaugguggacggcugguacggguaccaccaccagaacgagcagggcuccggguacgccgccgaccucaagucgacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 6520 - RNA, 1701 nt, Artificial Sequence
  derived and/or modified CDS sequence (AUadapt) from InfluenzaA__ADT91182__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagccccugucgaccgccuccagcugguccuacaucguggagaccucguccagcgacaacggcacgugcuaccccggcgacuucaucgacuacgaggagcuccgggagcagcuguccucgguguccucguucgagcgcuucgagaucuuccccaagaccuccagcuggccgaaccacgacuccaacaagggggucaccaccgccugcccccacgccggcgccaagucguucuacaagaaccugaucuggcucgugaagaaggggaacuccuaccccaagcugagcaaguccuacaucaacgacaagggcaaggaggugcugguccucugggggauccaccacccgcccacgucggcggaccagcagagccuguaccagaacgccgacgccuacguguucgugggcaccucccgguacucgaagaaguucaagcccgagaucgccauccgccccaagguccgggaccaggagggccgcaugaacuacuacuggacccugguggagcccggggacaagaucaccuucgaggccacgggcaaccucguggucccgcgguacgcguucgccauggagcgcaacgccggguccggcaucaucaucucggacacccccgugcacgacugcaacacgaccugccagacccccaagggcgccaucaacaccucccugcccuuccagaacauccacccgaucaccaucgggaagugccccaaguacgucaagagcaccaagcugcggcucgccacgggccugcgcaacgugcccuccauccagucgcgggggcuguucggcgcgaucgccggguucaucgagggcggcuggaccgggaugguggacggcugguacggguaccaccaccagaacgagcagggcuccggguacgccgccgaccucaagagcacccagaacgccaucgacggcaucaccaacaaggugaacuccgucaucgagaagaugaacacgcaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacucgaacgugaagaaccucuacgagaagguccgcucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcucgagagcacccgcaucuaccagauccuggccaucuacuccaccgucgcgucgucccuggugcucguggucagccugggcgccaucucguucuggaugugcuccaacggcagccugcagugccggaucugcaucuga

SEQ ID NO: 6521 - RNA, 1701 nt, Artificial Sequence
  derived and/or modified CDS sequence (AUadapt) from InfluenzaA__ADU20561__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugggcggggucgcgccccugcaccucggcaagugcaacaucgccggguggauccugggcaacccggagugcgagucgcuguccaccgccagcuccuggucguacaucguggagaccuccagcuccgacaacggcacgugcuaccccggggacuucaucgacuacgaggagcuccgcgagcagcugucguccgugagcuccuucgagcgguucgagaucuuccccaagaccucguccuggcccaaccacgacagcaacaagggcgucaccgccgccugcccgcacgccggggcgaaguccuucuacaagaaccugaucuggcucgugaagaagggcaacucguaccccaagcuguccaagagcuacaucaacgacaaggggaaggaggugcugguccucuggggcauccaccaccccucgaccuccgccgaccagcagagccuguaccagaacgccgacgccuacguguucgugggcacgucccgcuacucgaagaaguucaagcccgagaucgccauccggccgaagguccgcgaccaggaggggcggaugaacuacuacuggacccugguggagcccggcgacaagaucaccuucgaggcgaccgggaaccucguggucccccgcuacgccuucgccauggagcggaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagucgaccaagcugcgccucgcgaccgggcugcggaacgugccguccauccagagccgcggccuguucggggccaucgccggcuucaucgagggcggguggacgggcaugguggacgggugguacggcuaccaccaccagaacgagcagggguccggcuacgccgccgaccucaagucgacccagaacgcgaucgacaagaucaccaacaaggugaacuccgucaucgagaagaugaacacccaguucacggccgugggcaaggaguucaaccaccuggagaagcggaucgagaaccugaacaagaaggucgacgacggguuccucgacaucuggaccuacaacgccgagcugcuggugcuccuggagaacgagcgcacccuggacuaccacgacagcaacgugaagaaccucuacgagaagguccggucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgcgaggagaucgacggggugaagcucgagagcacccggaucuaccagauccuggcgaucuacuccaccgucgccucgagccuggugcucguggucucccugggcgccaucucguucuggaugugcuccaacggcagccugcagugccgcaucugcaucuga

SEQ ID NO: 6522 - RNA, 1701 nt, Artificial Sequence
  derived and/or modified CDS sequence (AUadapt) from InfluenzaA__ADU20562__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaagaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 6523 - RNA, 1701 nt, Artificial Sequence
  derived and/or modified CDS sequence (AUadapt) from InfluenzaA__ADU25478__HA
auggaggccaagcuguucguccucuucugcgccuucaccgcgcugaaggccgacaccaucugcgugggcuaccacgccaacaacucgacggacaccguggacaccauccuggagcgcaacgugaccgucacgcacuccgugaaccuccuggagagcucccacaacgggaagcugugcagccucaacggcaaggcgccccugcagcuggggaacugcaacguggccggcuggauccucgggaacccggagugcgaccugcugcucaccgucaacuccuggucguacaucaucgagaccuccaccagcaagaacggcgccugcuaccccggcgaguucgccgacuacgaggagcugcgggagcagcuguccacggugagcuccuucgagcgcuucgagaucuuccccaaggccaccucguggcccaaccacgagaccaccaaggggacgaccguggccugcucccacagcggcgcgaacuccuucuaccggaaccuccuguggaucgucaagaaggggaacagcuacccgaagcuguccaagucguacaccaacaacaagggcaaggaggugcucgugaucuggggcguccaccacccgcccaccgacuccgaccagcagacgcuguaccagaacaaccacaccuacgugagcguggggagcuccaaguacuaccagcgcuucacccccgagaucgucacccggcccaaggugcgcgagcaggccggccggaugaacuacuacuggacgcugcucgaccagggggacaccaucaccuucgaggccaccggcaaccugaucgcccccuggcacgccuucgcgcugaacaaggggucguccagcggcaucaugauguccgacgcccacgugcacaacugcacgaccaagugccagacgccccacggcgcccucaagagcaaccugcccuuccagaacguccacccgaucaccaucggggagugccccaaguacgugaaguccacccagcugcgcauggccaccggccuccggaacauccccucgauccagucccgcgggcuguucggcgccaucgcgggguucaucgagggcggcuggaccgggaugaucgacggcugguacggguaccaccaccagaacgagcagggcagcggguacgccgccgaccagaaguccacccagaucgccaucgacggcaucagcaacaaggugaacuccgucaucgagaagaugaacgugcaguucacgucggugggcaaggaguucaacaaccuggagaagcggaucgagaaccucaacaagaaggucgacgacggguuccuggacaucuggaccuacaacgccgagcugcucauccugcuggagaacgagcgcacccucgacuuccacgacuucaacgugaagaaccuguacgagcgggucaagucccagcugcgcaacaacgcgaaggagaucggcaacgggugcuucgaguucuaccacaagugcaacaacgagugcauggagagcgugaagaacggcaccuacaacuacccccgguacuccgaggagagcaagcucaaccgcgaggagaucgacggggugaagcuggaguccgucggcgugcaccagauccuggccaucuacucgacgguggccagcucccucguccugcuggugagccucggcgccaucuccuucuggaugugcagcaacgggucccugcagugccggaucugcaucuga

SEQ ID NO: 6524 - RNA, 1701 nt, Artificial Sequence
  derived and/or modified CDS sequence (AUadapt) from InfluenzaA__ADU59558__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccggggccaggaggggcgcaugaacuacuacuggacccugguggagcccggcgacaagaucaccuucgaggcgaccgggaaccucguggucccccgguacgccuucgccauggagcgcaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagucgaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcucgagagcacccgcaucuaccagauccuggcgaucuacuccaccgucgccucgagccuggugcucguggucucccugggcgccaucucguucuggaugugcuccaacggcagccugcagugccggaucugcaucuga

SEQ ID NO: 6525 - RNA, 1701 nt, Artificial Sequence; identical to SEQ ID NO: 116
  derived and/or modified CDS sequence (AUadapt) from InfluenzaA__ADU59579__HA

SEQ ID NO: 6526 - RNA, 1701 nt, Artificial Sequence; identical to SEQ ID NO: 116
  derived and/or modified CDS sequence (AUadapt) from InfluenzaA__ADU59590__HA

SEQ ID NO: 6527 - RNA, 1701 nt, Artificial Sequence; identical to SEQ ID NO: 116
  derived and/or modified CDS sequence (AUadapt) from InfluenzaA__ADU59601__HA

SEQ ID NO: 6528 - RNA, 1701 nt, Artificial Sequence; identical to SEQ ID NO: 116
  derived and/or modified CDS sequence (AUadapt) from InfluenzaA__ADU59612__HA

SEQ ID NO: 6529 - RNA, 1701 nt, Artificial Sequence; identical to SEQ ID NO: 116
  derived and/or modified CDS sequence (AUadapt) from InfluenzaA__ADU59768__HA

SEQ ID NO: 6530 - RNA, 1701 nt, Artificial Sequence; identical to SEQ ID NO: 116
  derived and/or modified CDS sequence (AUadapt) from InfluenzaA__ADU59769__HA

SEQ ID NO: 6531 - RNA, 1701 nt, Artificial Sequence; identical to SEQ ID NO: 116
  derived and/or modified CDS sequence (AUadapt) from InfluenzaA__ADU59771__HA

SEQ ID NO: 6532 - RNA, 1701 nt, Artificial Sequence; identical to SEQ ID NO: 116
  derived and/or modified CDS sequence (AUadapt) from InfluenzaA__ADU59772__HA

SEQ ID NO: 6533 - RNA, 1701 nt, Artificial Sequence; identical to SEQ ID NO: 116
  derived and/or modified CDS sequence (AUadapt) from InfluenzaA__ADU59774__HA

SEQ ID NO: 6534 - RNA, 1701 nt, Artificial Sequence; identical to SEQ ID NO: 116
  derived and/or modified CDS sequence (AUadapt) from InfluenzaA__ADU59906__HA

SEQ ID NO: 6535 - RNA, 1701 nt, Artificial Sequence; identical to SEQ ID NO: 116
  derived and/or modified CDS sequence (AUadapt) from InfluenzaA__ADU59916__HA

SEQ ID NO: 6536 - RNA, 1701 nt, Artificial Sequence; identical to SEQ ID NO: 116
  derived and/or modified CDS sequence (AUadapt) from InfluenzaA__ADU76756__HA

SEQ ID NO: 6537 - RNA, 1701 nt, Artificial Sequence; identical to SEQ ID NO: 116
  derived and/or modified CDS sequence (AUadapt) from InfluenzaA__ADU76757__HA

SEQ ID NO: 6538 - RNA, 1701 nt, Artificial Sequence; identical to SEQ ID NO: 116
  derived and/or modified CDS sequence (AUadapt) from InfluenzaA__ADU76758__HA

SEQ ID NO: 6539 - RNA, 1701 nt, Artificial Sequence; identical to SEQ ID NO: 116
  derived and/or modified CDS sequence (AUadapt) from InfluenzaA__ADU76759__HA

SEQ ID NO: 6540 - RNA, 1701 nt, Artificial Sequence; identical to SEQ ID NO: 3274
  derived and/or modified CDS sequence (AUadapt) from InfluenzaA__ADU76761__HA

SEQ ID NO: 6541 - RNA, 1701 nt, Artificial Sequence; identical to SEQ ID NO: 116
  derived and/or modified CDS sequence (AUadapt) from InfluenzaA__ADU76762__HA

SEQ ID NO: 6542 - RNA, 1701 nt, Artificial Sequence
  derived and/or modified CDS sequence (AUadapt) from InfluenzaA__ADU76764__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggaggccuccucguccaacaacgggaccugcuaccccggcgacuucaucgacuacgaggagcuccgggagcagcugagcuccgugucguccuucgagcgcuucgagaucuuccccaagacgagcuccuggcccaaccacgacucgaacaagggcgucaccgccgccugcccgcacgcgggcgccaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcaccucccgguacagcaagaaguucaagcccgagaucgcgauccgcccgaagguccgggaccaggagggccgcaugaacuacuacuggacgcugguggagcccggggacaagaucaccuucgaggccaccggcaaccucguggucccccgguacgccuucgccauggagcgcaacgccggguccggcaucaucaucucggacacccccgugcacgacugcaacacgaccugccagaccccgaagggcgcgaucaacaccucccugcccuuccagaacauccaccccaucacgaucgggaagugccccaaguacgucaagagcaccaagcugcggcucgccaccggccugcgcaacgugccguccauccagucgcgggggcuguucggcgccaucgccggguucaucgagggcggcuggaccgggaugguggacggcugguacggguaccaccaccagaacgagcagggcuccggguacgccgcggaccucaagagcacgcagaacgccaucgacgagaucaccaacaaggugaacuccgucaucgagaagaugaacacccaguucaucgccgugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacucgaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggcgaagcugaaccgggaggagaucgacggcgugaagcucgagucgacccgcaucuaccagauccuggccaucuacuccaccgucgccagcucgcuggugcucguggucucccugggggccaucagcuucuggaugugcuccaacggcagccugcagugccggaucugcaucuga

SEQ ID NO: 6543 - RNA, 1701 nt, Artificial Sequence
  derived and/or modified CDS sequence (AUadapt) from InfluenzaA__ADU76765__HA
augaaggccauccugaucgugcuccuguacaccuucgccaccgcgaacgccgacacgcugugcaucggcuaccacgccaacaacucgaccgacaccgucgacaccgugcucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagagccuguccaccgccucguccuggagcuacaucgucgagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggugaccgccgccugcccgcacgccggcgcgaaguccuucuacaagaaccugaucuggcucgucaagaaggggaacagcuaccccaagcuguccaagucguacaucaacgacaagggcaaggaggugcuggugcucugggggauccaccaccccagcaccuccgccgaccagcagucgcuguaccagaacgccgacgccuacgucuucgugggcacgucccgguacagcaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucucggacacgcccguccacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacucgaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagucgacccgcaucuaccagauccuggcgaucuacuccagcguggccucgucccugguccucguggugagccugggggccaucuccuucuggaugugcagcaacggcucccugcagugccggaucugcaucuga

SEQ ID NO: 6544 - RNA, 1701 nt, Artificial Sequence; identical to SEQ ID NO: 4511
  derived and/or modified CDS sequence (AUadapt) from InfluenzaA__ADU76766__HA

SEQ ID NO: 6545 - RNA, 1701 nt, Artificial Sequence
  derived and/or modified CDS sequence (AUadapt) from InfluenzaA__ADU76767__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 6546 - RNA, 1701 nt, Artificial Sequence
  derived and/or modified CDS sequence (AUadapt) from InfluenzaA__ADU76768__HA
augaaggccauccuggugguccuccuguacaccuucgccaucgcgaacgccgacacccugugcaucggcuaccacgccaacaacucgacggacaccguggacaccgugcucgagaagaacgucaccgugacgcacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacgggaccugcuaccccggcgacuucaucgacuacgaggagcuccgggagcagcugagcuccgugucguccuucgagcgcuucgagaucuuccccaagacgagcuccuggcccaaccacgacucgaacaagggcgucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcaccuccaaguacagcaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccggguccggcaucaucaucucggacacccccgugcacgacugcaacacgaccugccagaccccgaagggcgccaucaacaccucccugcccuuccagaacauccaccccaucacgaucgggaagugccccaaguacgucaagagcaccaagcugcgccucgcgaccggccugcggaacgugccguccauccagucgcgcgggcuguucggcgccaucgccggguucaucgagggcggcuggaccgggaugguggacggcugguacggguaccaccaccagaacgagcagggcuccggguacgccgccgaccucaagagcacgcagcacgcgaucgacgagaucaccaacaaggugaacuccgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacucgaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucaacggcgugaagcucgagucgacccggaucuaccagauccuggcgaucuacuccaccgucgccagcucgcuggugcucguggucucccugggggccaucagcuucuggaugugcuccaacggcagccugcagugccgcaucugcaucuga

SEQ ID NO: 6547 - RNA, 1701 nt, Artificial Sequence; identical to SEQ ID NO: 116
  derived and/or modified CDS sequence (AUadapt) from InfluenzaA__ADU76769__HA

SEQ ID NO: 6548 - RNA, 1701 nt, Artificial Sequence; identical to SEQ ID NO: 116
  derived and/or modified CDS sequence (AUadapt) from InfluenzaA__ADU76770__HA

SEQ ID NO: 6549 - RNA, 1701 nt, Artificial Sequence; identical to SEQ ID NO: 116
  derived and/or modified CDS sequence (AUadapt) from InfluenzaA__ADU76771__HA

SEQ ID NO: 6550 - RNA, 1701 nt, Artificial Sequence; identical to SEQ ID NO: 3659
  derived and/or modified CDS sequence (AUadapt) from InfluenzaA__ADU76772__HA

SEQ ID NO: 6551 - RNA, 1701 nt, Artificial Sequence; identical to SEQ ID NO: 116
  derived and/or modified CDS sequence (AUadapt) from InfluenzaA__ADU76774__HA

SEQ ID NO: 6552 - RNA, 1701 nt, Artificial Sequence; identical to SEQ ID NO: 116
  derived and/or modified CDS sequence (AUadapt) from InfluenzaA__ADU76775__HA

SEQ ID NO: 6553 - RNA, 1701 nt, Artificial Sequence; identical to SEQ ID NO: 116
  derived and/or modified CDS sequence (AUadapt) from InfluenzaA__ADU76776__HA

SEQ ID NO: 6554 - RNA, 1701 nt, Artificial Sequence; identical to SEQ ID NO: 116
  derived and/or modified CDS sequence (AUadapt) from InfluenzaA__ADU76777__HA

SEQ ID NO: 6555 - RNA, 1701 nt, Artificial Sequence; identical to SEQ ID NO: 116
  derived and/or modified CDS sequence (AUadapt) from InfluenzaA__ADU76778__HA

SEQ ID NO: 6556 - RNA, 1701 nt, Artificial Sequence; identical to SEQ ID NO: 5772
  derived and/or modified CDS sequence (AUadapt) from InfluenzaA__ADU76779__HA

SEQ ID NO: 6557 - RNA, 1701 nt, Artificial Sequence; identical to SEQ ID NO: 116
  derived and/or modified CDS sequence (AUadapt) from InfluenzaA__ADU76780__HA

SEQ ID NO: 6558 - RNA, 1701 nt, Artificial Sequence; identical to SEQ ID NO: 4511
  derived and/or modified CDS sequence (AUadapt) from InfluenzaA__ADU76781__HA

SEQ ID NO: 6559 - RNA, 1701 nt, Artificial Sequence; identical to SEQ ID NO: 3274
  derived and/or modified CDS sequence (AUadapt) from InfluenzaA__ADU76782__HA

SEQ ID NO: 6560 - RNA, 1701 nt, Artificial Sequence
  derived and/or modified CDS sequence (AUadapt) from InfluenzaA__ADU76784__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccaacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 6561 - RNA, 1701 nt, Artificial Sequence; identical to SEQ ID NO: 116
  derived and/or modified CDS sequence (AUadapt) from InfluenzaA__ADU76785__HA

SEQ ID NO: 6562 - RNA, 1701 nt, Artificial Sequence; identical to SEQ ID NO: 116
  derived and/or modified CDS sequence (AUadapt) from InfluenzaA__ADU76786__HA

SEQ ID NO: 6563 - RNA, 1701 nt, Artificial Sequence
  derived and/or modified CDS sequence (AUadapt) from InfluenzaA__ADU76787__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccacaacauccacagcaucaccaucgggaagugccccaaguacgugaaguccaccaagcugcggcucgcgaccggccugcgcaacguccccucgauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacucggucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuacccgaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 6564 - RNA, 1701 nt, Artificial Sequence; identical to SEQ ID NO: 6545
  derived and/or modified CDS sequence (AUadapt) from InfluenzaA__ADU76788__HA

SEQ ID NO: 6565 - RNA, 1701 nt, Artificial Sequence; identical to SEQ ID NO: 6545
  derived and/or modified CDS sequence (AUadapt) from InfluenzaA__ADU76789__HA

SEQ ID NO: 6566 - RNA, 1701 nt, Artificial Sequence; identical to SEQ ID NO: 116
  derived and/or modified CDS sequence (AUadapt) from InfluenzaA__ADU76790__HA

SEQ ID NO: 6567 - RNA, 1701 nt, Artificial Sequence; identical to SEQ ID NO: 116
  derived and/or modified CDS sequence (AUadapt) from InfluenzaA__ADU76791__HA

SEQ ID NO: 6568 - RNA, 1701 nt, Artificial Sequence; identical to SEQ ID NO: 6545
  derived and/or modified CDS sequence (AUadapt) from InfluenzaA__ADU76792__HA

SEQ ID NO: 6569 - RNA, 1701 nt, Artificial Sequence
  derived and/or modified CDS sequence (AUadapt) from InfluenzaA__ADU76793__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagaaguucgagaucuuccccaagaccucguccuggcccaaccacgacagcaacaagggggucaccgccgccugcccgcacgccggcaccaaguccuucuacaagaaccugaucuggcucgugaagaaggggaacucguaccccaagcuguccaagagcuacaucaacgacaagggcaaggaggugcugguccucugggggauccaccaccccucgacguccgcggaccagcagagccuguaccagaacgccgacgccuacguguucgugggcaccucccgcuacucgaagaaguucaagcccgagaucgccauccggccgaagguccgcgaccaggagggccggaugaacuacuacuggacccugguggagcccggggacaagaucaccuucgaggccacgggcaaccucguggucccccgcuacgcguucgccauggagcggaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcgccucgccacgggccugcggaacgugccguccauccagagccgcgggcuguucggcgcgaucgccggguucaucgagggcggcuggaccgggaugguggacggcugguacggguaccaccaccagaacgagcagggcuccggguacgccgccgaccucaagucgacccagaacgccaucgacaagaucaccaacaaggugaacuccgucaucgagaagaugaacacgcaguucaccgcggugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggccaucuacuccaccgucgcgucgagccuggugcucguggucucccugggggccaucucguucuggaugugcuccaacggcagccugcagugccgcaucugcaucuga

SEQ ID NO: 6570 - RNA, 1701 nt, Artificial Sequence
  derived and/or modified CDS sequence (AUadapt) from InfluenzaA__ADU85911__HA
augaaggccaucaucgugguccugcucuacaccuucgccaccgcggacgccgacacgcugugcaucggcuaccacgccaacaacucgaccgacaccguggacaccgugcuggagaagaacgucacggugacccacuccgugaaccuccuggagaacaagcacaacgggaagcugugcaagcucggcgggaucgcgccccugcaccugggcaagugcgacaucgccggguggcuccugggcaacccggagugcgagucgcuguucaccgccuccagcugguccuacaucgucgagacccccaacucggacaacggcacgugcuaccccggggacuucaucaacuacgaggagcuccgcgagcaccuguccagcguguccucguucgagcgguucgagaucuuccccaaggccaacuccuggccgaaccacgacaccaacaagggcgugaccgccgccugccccuacgcgggggccaacagcuucuaccgcaaccugaucuggcucgucaagaagggcaacuccuaccccaagcugucgaaguccuacaucaacaacaagaagaaggaggugcuggugaucugggggauccaccacccgcccaccucgacggaccagcagacccucuaccagaacgccgacgccuacgucuucgugggcuccagcaaguacuccaagcgguucaagcccgagaucgccgcgcgccccaaggugcgggaccaggccggccgcauggacuacuacuggacccugaucgagcccggggacaccaucacguucgaggccaccggcaaccuggucgugccgcgguacgccuucgccaugaagcgcgggucgggcagcggcaucaucguguccgacgcgcccguccacgacugcaacacgaccugccagacccccaagggggccaucaacaccucgcuccccuuccagaacauccacccggugaccaucggcgagugccccaaguacgugaaguccaccaagcugcggauggccacggggcugcgcaacauccccagcauccagucccggggccucuucggggccaucgccggcuuccuggagggcggguggaccggcaugaucgacgggugguacggcuaccaccaccagaacgagcaggggucgggcuacgcggccgaccagaaguccacccagaacgccaucgacggcaucaccaacaaggucaacucgaucaucgagaagaugaacacgcaguucaccgccguggggaaggaguucucccagcuggagaagcgcaucgagagccucaacaacaagguggacgacggcuuccuggacaucuggaccuacaacgccgagcugcucguccugcuggagaacgagcggacccucgacuaccacgacuccaacgugaagaaccuguacgagaagguccgcucgcagcugaagaacaacgcgaaggagaucgggaacggcugcuucgaguucuaccacaagugcgacaacacgugcauggaguccgugaagaacgggaccuacgacuaccccaaguacagcgaggaggccaagcucaaccgggaggagaucgacggcgugaagcuggaguccgcccgcaucuaccagauccuggccaucuacucgaccgucgcguccagccucgugcugcuggugucccucggcgccaucucguucuggaugugcagcaacgggucccugcagugccggaucugcaucuga

SEQ ID NO: 6571 - RNA, 1701 nt, Artificial Sequence; identical to SEQ ID NO: 4078
  derived and/or modified CDS sequence (AUadapt) from InfluenzaA__ADV17283__HA

SEQ ID NO: 6572 - RNA, 1701 nt, Artificial Sequence; identical to SEQ ID NO: 4078
  derived and/or modified CDS sequence (AUadapt) from InfluenzaA__ADV17293__HA

SEQ ID NO: 6573 - RNA, 1701 nt, Artificial Sequence
  derived and/or modified CDS sequence (AUadapt) from InfluenzaA__ADV17303__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaagggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagucgacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 6574 - RNA, 1701 nt, Artificial Sequence; identical to SEQ ID NO: 4078
  derived and/or modified CDS sequence (AUadapt) from InfluenzaA__ADV17313__HA

SEQ ID NO: 6575 - RNA, 1701 nt, Artificial Sequence
  derived and/or modified CDS sequence (AUadapt) from InfluenzaA__ADV17323__HA
augaaggccauccuggugguccuccuguacaccuucgccaccacgaacgcggacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagacguccagcuccgacaacgggaccugcuaccccggcgacuucaucgacuacgaggagcuccgggagcagcugucguccgugagcuccuucgagcgcuucgagaucuuccccaagaccaacucguggcccaaccacgacuccaacaagggcgucaccgccgccugcccgcacgccggcgccaagucguucuacaagaaccugaucuggcucgugaagaaggggaacuccuaccccaagcugagcaaguccuacaucaacgacaagggcaaggaggugcugguccucugggggauccaccaccccucgacgagcgcggaccagcagggccuguaccagaacgccgacgccuacguguucgugggcaccucccgguacucgaagaaguucaagcccgagaucgccauccgcccgaagguccgggaccaggaggggcgcaugaacuacuacuggacccugguggagcccggcgacaagaucaccuucgaggccacggggaaccucguggucccccgguacgcguucgccauggagcgcaacgccggcuccggcaucaucaucagcgacacccccgugcacgacugcaacacgaccugccagaccccggagggggccaucaacaccucccugcccuuccagaacauccaccccaucaccaucggcaagugccccaaguacgucaagucgaccaagcugcggcucgccacggggcugcgcaacgugccguccauccagucgcggggccuguucggggcgaucgccggcuucaucgagggcggguggaccggcaugguggacgggugguacggcuaccaccaccagaacgagcagggguccggcuacgccgccgaccucaagagcacccagaacgccaucgacaagaucaccaacaaggugaacuacgucaucgagaagaugaacacgcaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcaucuaccagauccuggccaucuacucgaccgucgcguccagccuggugcucguggucucccugggcgccaucucguucuggaugugcagcaacggcucccugcagugccggaucugcaucuga

SEQ ID NO: 6576 - RNA, 1701 nt, Artificial Sequence
  derived and/or modified CDS sequence (AUadapt) from InfluenzaA__ADV17333__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccagcaccuccgccgaccagcagaaccuguaccagaacgccgacgccuacguguucgugggcacgucgcgguacuccaagaaguucaagcccgagaucgccauccgcccgaagguccgggaccaggagggccgcaugaacuacuacuggacccugguggagcccggggacaagaucaccuucgaggcgaccggcaaccucgugguccugcgguacgccuucgccauggagcgcaacgccgggagcggcaucaucaucuccgacacgcccgugcacgacugcaacacgaccugccagacccccaagggcgccaucaacaccucgcugccguuccagaacauccaccccaucaccaucgggaagugccccaaguacgugaaguccaccaagcuccggcuggcgaccggccugcgcaacguccccagcauccagucccggggccucuucggggccaucgccggguucaucgagggcggcuggacggggaugguggacggcugguacggguaccaccaccagaacgagcagggcucgggguacgccgccgaccugaaguccacccagaacgcgaucgacaagaucaccaacaaggugaacagcgucaucgagaagaugaacacccaguucacggccgugggcaaggaguucaaccaccuggagaagcgcaucgagaaccucaacaagaaggucgacgacggcuuccuggacaucuggaccuacaacgccgagcugcucgugcugcuggagaacgagcggacccucgacuacuacgacuccaacgugaagaaccuguacgagaagguccgcagccagcugaagaacaacgccaaggagaucgggaacggcugcuucgaguucuaccacaagugcgacaacacgugcauggaguccgugaagaacgggaccuacgacuacccgaaguacucggaggaggccaagcucaaccgggaggagaucgacggcgugaagcuggaguccacccgcaucuaccagauccuggucaucuacagcaccguggcguccucgcucgugcuggucgugagccugggggccaucuccuucuggaugugcagcaacggcucccuccagugccggaucugcaucuga

SEQ ID NO: 6577 - RNA, 1701 nt, Artificial Sequence; identical to SEQ ID NO: 116
  derived and/or modified CDS sequence (AUadapt) from InfluenzaA__ADV19019__HA

SEQ ID NO: 6578 - RNA, 1701 nt, Artificial Sequence; identical to SEQ ID NO: 3399
  derived and/or modified CDS sequence (AUadapt) from InfluenzaA__ADV41677__HA

SEQ ID NO: 6579 - RNA, 1701 nt, Artificial Sequence
  derived and/or modified CDS sequence (AUadapt) from InfluenzaA__ADV58939__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaagggguucuacaagaaccugaucuggcucgugaagaagggcaacuccuaccccaagcugucgaaguccuacaucaacgacaaggggaaggaggugcugguccucuggggcauccaccaccccagcaccacggccgaccagcagucgcuguaccagaacgccgacaccuacguguucgugggcaccucccgguacagcaagaaguucaagcccgagaucgccauccgcccgaagguccgggaccaggaggggcgcaugaacuacuacuggacccugguggagcccggcgacaagaucacguucgaggccaccgggaaccucguggucccccgguacgcguucgccauggagcgcaacgccggcuccggcaucaucaucucggacacccccgugcacgacugcaacaccacgugccagaccccgaagggggccaucaacaccucccugcccuuccagaacauccaccccaucaccaucggcaagugccccaaguacgucaagucgacgaagcugcggcucgccaccgggcugcgcaacgugccguccauccagagccggggccuguucggggcgaucgccggcuucaucgagggcggguggaccggcaugguggacgggugguacggcuaccaccaccagaacgagcagggguccggcuacgccgccgaccucaagucgacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacgcuggacuaccacgacagcaacgugaagaaccucuacgagaagguccgcaaccagcugaagaacaacgccaaggagaucggcaacgggugcuucgaguucuaccacaagugcgacaacacgugcauggaguccgugaagaacgagaccuacgacuaccccaaguacucggaggaggccaagcugaaccgggaggagaucgacggcgugaagcucgaguccacccgcaucuaccagauccuggccaucuacucgaccgucgcguccagccuggugcucguggucucccugggggccaucucguucuggaugugcagcaacggcucccugcagugccggaucugcaucuga

SEQ ID NO: 6580 - RNA, 1698 nt, Artificial Sequence
  derived and/or modified CDS sequence (AUadapt) from InfluenzaA__ADV69074__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcaacgucgccggcuggauccuggggaacccggagugcgagcuccugaucuccaaggagagcugguccuacaucguggagacccccgaccccgagaacggcacgugcuaccccggcuacuucaccgacuacgaggagcugcgcgagcagcucagcuccgugucguccuucaagcgguucgagaucuucccgaaggagagcuccuggcccaaccacaccgucaccggggugagcgccuccugcagccacaacggcaaguccucguucuaccgcaaccugcuguggcucacggugaagaacgggcuguaccccaaccuguccaagagcuacaccaacgacaaggagaaggagguccucgugcuguggggcgugcaccacccgcccuccaucggggaccagcggacccuguaccacaccgagaacgccuacgucagcguggugagcucccacuacucgcgccgguucacgcccgagaucgucaagcgccccaaggugcgggaccaggagggccgcaucaacuacuacuggacccuccuggagcccggcgacaccaucaucugcgaggccaacgggaaccugaucgccccgcgguacgccuucgcccucucccgcggccuggggagcggcaucaucaccuccaacgcgcccaugggcgagugcaacgccaagugccagacgccccagggggccaucaacagcucccugcccuuccagaacgugcacccggucaccaucggcgagugccccaaguacgucaagagcgccaagcuccggauggugaccgggcugcgcaacacccccuccauccagucgcggggccuguucggggccaucgcgggcuucaucgagggcggguggacgggcaugguggacgggugguacggcuaccaccaccagaacgagcagggguccggcuacgccgccgaccagaaguccacccagaacgccaucaacggcaucaccaacaaggugaacagcgucaucgagaagaugaacacccaguucacggccguggggaaggaguucaacaagcucgagcgccggauggagaaccugaacaagaagguggacgacggcuuccuggacaucuggaccuacaacgcggagcuccugguccugcucgagaacgagcgcacccuggacuuccacgacagcaacgugaagaaccuguacgagaaggugaagucccagcucaagaacaacgccaaggagaucgggaacggcugcuucgaguucuaccacaagugcaacgacgagugcauggagagcgucaagaacgggaccuacgacuaccccaaguacuccgaggagucgaagcugaaccgggagaagaucgacggcgugaagcuggaguccauggagguguaccagauccucgccaucuacagcacggucgccagcucccugguguuccugguggcccucggcgcgaucugcuucuggaugugcagcaacgggucccugcagugcaagaucugcaucuga

SEQ ID NO: 6581 - RNA, 1698 nt, Artificial Sequence
  derived and/or modified CDS sequence (AUadapt) from InfluenzaA__ADV69075__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcaacgucgccggcuggauccuggggaacccggagugcgagcuccugaucuccaaggagagcugguccuacaucguggagacccccgaccccgagaacggcacgugcuaccccggcuacgugaccgacuacgaggagcugcgcgagcagcucagcuccgucucguccuucaagcgguucgagaucuucccgaaggagagcuccuggcccaaccacaccgugaccggggugagcgccuccugcagccacaacggcaaguccagcuucuaccgcaaccugcuguggcucacggucaagaacgggcuguaccccaaccuguccaagucguacaccaacgacaaggagaaggaggugcucgugcuguggggcguccaccacccgcccuccaucggggaccagcggacccuguaccacaccgagaacgccuacgugagcguggucagcucccacuacagccgccgguucacgcccgagaucgugaagcgccccaaggugcgggaccaggagggccgcaucaacuacuacuggacccuccuggagcccggcgacaccaucaucugcgaggccaacgggaaccugaucgccccgcgguacgccuucgcccucucccgcggcuucgggagcggcaucaucaccuccaacgcgcccaugggcgagugcaacgccaagugccagacgccccagggggccaucaacucgucccugcccuuccagaacguccacccggugaccaucggcgagugccccaaguacgucaagagcgccaagcugcggauggugaccgggcuccgcaacacccccuccauccagagccggggccuguucggggccaucgcgggcuucaucgagggcggguggacgggcaugguggacgggugguacggcuaccaccaccccaacgagcagggguccggcuacgccgccgaccagaaguccacccagaacgccaucaacggcaucaccaacaaggucaacagcgugaucgagaagaugaacacccaguucacggccguggggaaggaguucaacaagcuggagcgccggauggagaaccucaacaagaaggucgacgacggcuuccuggacaucuggaccuacaacgcggagcugcucgugcugcuggagaacgagcgcacccucgacuuccacgacagcaacgugaagaaccuguacgagaaggucaagucccagcugaagaacaaggugaaggagaucgggaacggcugcuucgaguucuaccacaagugcaacgacgagugcauggagucggugaagaacgggaccuacgacuacccgaaguacuccgaggagagcaagcucaaccgggagaagaucgacggcgucaagcuggaguccauggagguguaccagauccuggccaucuacagcacgguggccagcucccucgucuuccugguggcccugggcgccaucugcuucuggaugugcagcaacgggucccuccagugcaagaucugcaucuga

SEQ ID NO: 6582 - RNA, 1698 nt, Artificial Sequence
  derived and/or modified CDS sequence (AUadapt) from InfluenzaA__ADV69077__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcaacgucgccggcuggauccuggggaacccggagugcgagcuccugaucuccaaggagagcugguccuacaucguggagacccccgaccccgagaacggcacgugcuaccccggcuacuucaccgacuacgaggagcugcgcgagcagcucagcuccgugagcuccuucaagcgguucgagaucuucccgaaggagagcuccuggcccaaccacaccgucaccggggugucggccuccugcagccacaacggcaaguccagcuucuaccgcaaccugcuguggcucacggugaagaacgggcuguaccccaaccuguccaagagcuacaccaacgacaaggagaaggagguccucgugcuguggggcgugcaccacccgcccuccaucggggaccagcggacccuguaccacaccgagaacgccuacgucagcguggugagcucccacuacucgcgccgguucacgcccgagaucgucaagcgccccaaggugcgggaccaggagggccgcaucaacuacuacuggacccuccuggagcccggcgacaccaucaucuucgaggccaacgggaaccugaucgccccgcgguacgccuucgcccucucccgcggcuucgggagcggcaucaucaccuccaacgcgcccaugggcgagugcaacgccaagugccagacgccccagggggccaucaacagcucccugcccuuccagaacgugcacccggucaccaucggcgagugccccaaguacgucaagagcgccaagcugcggauggugaccgggcuccgcaacacccccuccauccagagccggggccuguucggggccaucgcgggcuucaucgagggcggguggacgggcaugguggacgggugguacggcuaccaccaccagaacgagcagggguccggcuacgccgccgaccagaaguccacccagaacgccaucaacggcaucaccaacaaggugaacagcgucaucgagaagaugaacacccaguucacggccguggggaaggaguucaacaagcuggagcgccggauggagaaccucaacaagaagguggacgacggcuuccuggacaucuggaccuacaacgcggagcugcucguccugcuggagaacgagcgcacccucgacuuccacgacucgaacgugaagaaccuguacgagaaggugaagucccagcugaagaacaacgccaaggagaucgggaacggcugcuucgaguucuaccacaagugcaacgacgagugcauggagagcgucaagaacgggaccuacgacuaccccaaguacuccgaggagagcaagcucaaccgggagaagaucgacggcgugaagcuggaguccauggagguguaccagauccuggccaucuacagcacggucgccagcucccucguguuccugguggcccugggcgcgaucugcuucuggaugugcagcaacgggucccuccagugcaagaucugcaucuga

SEQ ID NO: 6583 - RNA, 1698 nt, Artificial Sequence
  derived and/or modified CDS sequence (AUadapt) from InfluenzaA__ADV69078__HA
augaaggugaagcugcucauccugcugugcaccuucaccgccacguacgccgacaccaucugcaucggcuaccacgcgaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagagccucaucuccaagaaguccuggucguacaucgucgagacccccaaccccgagaacggcgccugcuaccccggcgaguucgccgacuacgaggagcugcgcgagcagcugagcuccgugagcuccuucgagcgguucgagaucuucccgaaggagucguccuggcccaaccacacggccgccggggugagcgccuccugcagccacaacggcgagaaguccuucuaccgcaaccucaucuggcugaccaagaagaacgggcuguaccccaaccucucgaaguccuacgagaacgacaaggagaaggagguccugauccuguggggcgugcaccacccgcccaacaucgagaaccagcggacccucuaccgcaccgagaacgccuacgugagcgucgugagcucccacuacagcgggcgguucacgcccgagaucaccaagcgccccaaggugcggaaccaggagggccgcaucaacuacuacuggacccugcuggagcccggcgacaccaucaucuucgaggcgaacgggaaccucaucgccccgugguacgccuucacgcugucccggggccuggggucgggcaucaucaccuccaacgcccccauggacgagugcgacgccaagugccagacgccccagggcgcgaucaacagcucccuccccuuccagaacguccacccggugaccaucggggagugccccaaguacgugcgcagcuccaagcugcggauggucaccggccugcgcaacauccccucgauccagucccggggccucuucggggccaucgccggguucaucgagggcggcuggaccgggaugguggacggcugguacggguaccaccaccagaacgagcagggcagcggguacgccgccgaccaggaguccacccagaacgcgaucaacggcaucaccaacaaggugaacagcgucaucgagaagaugaacacgcaguucaccgccgugggcaaggaguucaacaagcuggagcgccggauggagaaccugaacaagaagguggacgacggguuccucgacaucuggaccuacaacgccgagcugcugguccuccuggagaacgagcgcacccuggacuuccacgacuccaacgucaagucgcucuacgagaaggugaagucccagcugaagaacaacgccaaggagaucggcaacgggugcuucgaguucuaccacaagugcaacaacgagugcauggagagcgugaagaacggcacguacgacuaccccaaguacuccgaggagagcaagcugaaccgggagaagaucgacggggugaagcucgacucgaugggcgucuaccgcauccuggccaucuacuccaccguggcgagcucccuggugcuccuggucagccugggcgccaucuccuucuggaugugcagcaacgggucccuccagugccggaucugcaucuga

SEQ ID NO: 6584 - RNA, 1698 nt, Artificial Sequence
  derived and/or modified CDS sequence (AUadapt) from InfluenzaA__ADV69079__HA
augaaggugaagcugcucauccugcugugcaccuucaccgccacguacgccgacaccaucugcaucggcuaccacgcgaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaagaaguccuggagcuacaucgucaagacccccaaccccgagaacggcuccugcuaccccggcuacuucgccgacuacgaggagcugcgcgagcagcucagcuccgugagcuccuucgagcgguucgagauguucccgaaggagucguccuggcccaaccacaacgugaacggggucagcgccuccugcagccacaacggcaagcgcuccuucuaccggaaccugcuguggcucacggggaagaacggccuguaccccaaccugaccaagagcuacgagaacaacaacgagaaggaggugcucauccuguggggcgugcaccaccccuccaacaucggggaccagcgcacccuguaccacaccgagaacgccuacgucagcgugaugagcucccacuacagccggcgcuucacgccggagaucaacaagcggcccaaggugcgcgaccaggagggccggaucaacuacuacuggacccuccuggagcccggggacaccaucaucuucgaggccaacggcaaccugaucgcccccugguacgccuucgcgcucucccgcggguucggcucgggcaucaucaccuccagcgccccgauggacgagugcgacgccaagugccagacgccccgcggggccaucaacuccagccugcccuuccagaacguccaccccgugaccaucggcgagugcccgaaguacgugcgguccgccaagcugcggauggucaccgggcuccgcaacauccccagcauccagucccggggccuguucggggcgaucgccggcuucaucgagggcggguggaccggcaugguggacgggugguacggcuaccaccaccagaacgagcaggggagcggcuacgccgccgaccaggaguccacgcagaacgccaucaacggcaucaccaacaaggugaacagcgucaucgagaagaugaacacccaguucaccgcgguggggaaggaguucaacaagcuggagcgccggauggagaaccucaacaagaagguggacgacggcuuccuggacaucuggacguacaacgccgagcugcucguccugcuggagaacgagcgcacccucgacuuccacgacuccaacgucaagucgcuguacgagaaggugaagucccagcugaagaacaacgccaaggagaucgggaacggcugcuucgaguucuaccacaagugcaacaacgagugcauggagagcgugaagaacgggaccuacgacuaccccaaguacuccgaggagagcaagcucaaccgggagaagaucgacggcgugaagcuggacagcaugggcgucuaccagauccuggccaucuacuccaccguggccagcucccucgugcugcuggucagccucggggcgaucuccuucuggaugugcagcaacggcucccugcagugccgcaucugcaucuga

SEQ ID NO: 6585 - RNA, 1698 nt, Artificial Sequence
  derived and/or modified CDS sequence (AUadapt) from InfluenzaA__ADV69080__HA
augaaggugaagcugcucauccugcugugcaccuucaccgccacguacgccgacaccaucugcaucggcuaccacgcgaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagagccucaucuccaagaaguccuggucguacaucgucgagacccccaaccccgagaacggcgccugcuaccccggcgaguucgccgacuacgaggagcugcgcgagcagcugagcuccgugagcuccuucgagcgguucgagaucuucccgaaggagucguccuggcccaaccacacggccgccggggugagcgccuccugcagccacaacggcgagcgcuccuucuaccggaaccucaucuggcugaccaugaagaacgggcuguaccccaaccuccgcaagucguacgagaacgacaaggagaaggagguccugauccuguggggcgugcaccacccgcccaacaucgagaaccagcggacccucuaccacaccgagaacgccuacguguccgucgugagcagccacuacuccgggcgcuucacgcccgagaucaccaagcggcccaaggugcgcgaccaggagggccggaucaacuacuacuggacccugcuggagcccggcgacaccaucaucuucgaggcgaacgggaaccucaucgccccgugguacgccuucacgcugucgcgcggccugggguccggcaucaucaccagcaacgcccccauggacgccugcgacgcgaagugccagacgccccagggcgccaucaacuccagccuccccuuccagaacguccacccggugaccaucggggagugccccaaguacgugcgguccgccaagcugcgcauggucaccggccugcggaacauccccucgauccagucccgcggccucuucggggccaucgccggguucaucgagggcggcuggaccgggaugguggacggcugguacggguaccaccaccagaacgagcagggcagcggguacgcggccgaccaggaguccacccagaacgccaucaacggcaucaccaacaaggugaacagcgucaucgagaagaugaacacgcaguucaccgccgugggcaaggaguucaacaagcuggagcggcgcaucgagaaccugaacaagaagguggacgacggguucaucgacaucuggaccuacaacgccgagcuccugguccugcucgagaacgagcggacccuggacuuccacgacuccaacgucaagucgcuguacgagaaggugaagucccagcucaagaacaacgcgaaggagaucggcaacgggugcuucgaguucuaccacaagugcaacaacgagugcauggagagcgugaagaacggcacguacgacuaccccaaguacuccgaggagagcaagcugaaccgcgagaagaucgacggggugaagcuggacuccaugggcgucuaccggauccucgccaucuacucgaccguggccagcucccuggugcugcucgucagccugggcgccaucuccuucuggaugugcagcaacgggucccugcagugccgcaucugcaucuga

SEQ ID NO: 6586 - RNA, 1698 nt, Artificial Sequence
  derived and/or modified CDS sequence (AUadapt) from InfluenzaA__ADV69081__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcaacgucgccggcuggauccuggggaacccggagugcgagcuccugaucuccaaggagagcugguccuacaucguggagacccccaaccccgagaacggcacgugcuaccccggcuacuucaccgacuacgaggagcugcgcgagcagcucagcuccgugagcuccuucaagcgguucgagaucuucccgaaggagagcuccuggcccaaccacaccgucaccggggugucggccuccugcagccacaacggcgaguccagcuucuaccgcaaccugcuguggcucacggugaagaacgggcuguaccccaagcuguccaagagcuacaccaacgacaaggagaaggagguccucgugcuguggggcgugcaccacccgcccaacauccgggaccagcgcacccuguaccacaccgagaacgccuacgucuccguggugagcagccacuacucccggcgcuucacgcccgagaucgucaagcggcccaaggugcgcgaccaggaggggcggaucaacuacuacuggacccuccuggagcccggcgacaccaucaucuucgaggccaacggcaaccugaucgccccgcgcuacgccuucgcccucucgcggggguucggcuccgggaucaucaccagcaacgcgcccaugggcgagugcaacgccaagugccagacgccccagggcgccaucaucuccagccugcccuuccagaacgugcacccggucaccaucggggagugccccaaguacgugaaguccgccaagcugcgcauggugaccggccuccggaacacccccagcauccagucccgcgggcuguucggcgccaucgcgggguucaucgagggcggcuggacggggauggucgacggcugguacggguaccaccaccagaacgagcagggcagcggguacgccgccgaccagaaguccacccagaacgccaucaacggcaucaccaacaaggugaacagcgucaucgagaagaugaacacccaguucacggccgugggcaaggaguucaacaagcuggagcggcgcauggagaaccucaacaagaagguggacgacggguuccuggacaucuggaccuacaacgcggagcugcucguccugcuggagaacgagcggacccucgacuuccacgacuccaacgugaagaaccuguacgagaaggucaagucgcagcugaagaacaacgccaaggagaucggcaacgggugcuucgaguucuaccacaagugcaacgacgagugcauggaguccgugaagaacggcaccuacgacuaccccaaguacagcgaggaguccaagcucaaccgcgagaagaucgacggggugaagcuggagagcauggagguguaccagauccuggccaucuacuccacggucgccagcagccucguguuccugguggcccugggcgcgaucugcuucuggaugugcuccaacggcagccuccagugcaagaucugcaucuga

SEQ ID NO: 6587 - RNA, 1698 nt, Artificial Sequence
  derived and/or modified CDS sequence (AUadapt) from InfluenzaA__ADV69083__HA
augaaggugaagcugaugguccuccugugcaccuucaccgccacguacgccgacaccaucugcgugggcuaccacgcgaacaacucgaccgacaccguggacacgguccuggagaagaacgugaccgugacccacuccgucaaccuccuggaggacagccacaacgggaagcugugccuccugaagggcaucgcgccccugcagcucggguccugcagcguggccggcuggauccuggggaacccggagugcgagcugcucaucuccaaggagucgugguccuacaucguggagacccccaaccccgagaacggcacgugcuaccccggcuacuucaccgacuacgaggagcugcgcgagcagcugagcuccgucagcuccuucaagcgguucgagaucuucccgaaggagagcuccuggcccaaccacaacgugaccggggugucguccagcugcucccacaacggcaagagcuccuucuaccgcaaccuccuguggcugaccgucaagaacgggcucuaccccaaccugagcaagucguacacgaacaagaaggagaaggaggugcuggugcucuggggcguccaccaccccuccaacaucggggaccagcgggcccuguaccacaccgagaacgccuacgugagcguggucuccagccacuacucccgccgguucaccccggagaucgccaagcgccccaaggugcggaaccaggagggccgcaucaacuacuacuggacccugcucgagcccggcgacacgaucauccuggaggccaacgggaaccugaucgcgccccgguacgccuucgagcucagcaagggccugggguccggcaucaucaccucgaacgccccgaugggcgagugcaacgccaagugccagacgccccagggggccaucaacuccagccugcccuuccagaacgugcaccccgucaccaucggcgagugcccgaaguacgugaaguccgccaagcuccgcauggugaccgggcugcggaacacccccagcauccagucccgcggccuguucggggccaucgcgggcuucaucgagggcggguggaccggcauggucgacgggugguacggcuaccaccaccagaacgagcaggggagcggcuacgccgccgaccagcaguccacccagaacgccaucaacggcaucacgaacaaggugaacucggucaucgagaagaugaacacccaguucaccgccguggggaaggaguucaacaagcucgagcggcgcauggagaaccugaacaagaagguggacgacggcuuccuggacaucuggaccuacaacgcggagcuccugguccugcucgagaacgagcggacgcuggacuuccacgacuccaacgugaagaaccuguacgagaaggucaagagccagcucaagaacaacgccaaggagaucgggaacggcugcuucgaguucuaccacaagugcaacgacgagugcauggaguccgugaagaacgggaccuacgacuaccccaaguacagcgaggagagcaagcugaaccgcgagaagaucgacggcgugaagcuggaguccaugggcguguacaacauccucgccaucuacucgaccgucgccuccagccuggugcugcucgugucccugggggccaucagcuucuggaugugcuccaacggcagccugcagugccggaucugcaucuga

SEQ ID NO: 6588 - RNA, 1698 nt, Artificial Sequence
  derived and/or modified CDS sequence (AUadapt) from InfluenzaA__ADV69084__HA
augaaggugaagcugaugguccuccugugcaccuucaccgccacguacgccgacaccaucugcgugggcuaccacgcgaacaacucgaccgacaccguggacacgguccuggagaagaacgugaccgugacccacuccgucaaccuccuggaggacagccacaacgggaagcugugccuccugaagggcaucgcgccccugcagcucggguccugcagcguggccggcuggauccuggggaacccggagugcgagcugcucaucuccaaggagagcugguccuacaucguggagacccccaaccccgagaacggcacgugcuaccccggcuacuucaccgacuacgaggagcugcgcgagcagcugagcuccgucagcuccuucaagcgguucgagaucuucccgaaggagucguccuggcccaaccacaacgugaccggggugagcuccagcugcucccacaacggcaagagcuccuucuaccgcaaccuccuguggcugaccgucaagaacgggcucuaccccaaccugagcaagagcuacacgaacaagaaggagaaggaggugcugauccucuggggcgugcaccaccccuccaacauccgggaccagcgcgcccuguacuacaccgagaacgccuacgucagcgugguguccucgcacuacucccggcgcuucaccccggagaucgccaagcggcccaagguccgcaaccaggaggggcggaucaacuacuacuggacccugcucgagcccggcgacacgaucaucuucgaggccaacggcaaccugaucgcgccccgcuacgccuucgagcugagcaagggguucggcuccgggaucaucaccagcgacgccccgaugggcgagugcaacgccaagugccagacgccccagggcgccaucaacuccagccuccccuuccagaacgugcaccccgugaccaucggggagugcccgaaguacguccgguccgccaagcugcgcauggugaccggccugcggaacacccccagcauccagucccgcggccucuucggggccaucgcgggguucaucgagggcggcuggaccgggaugguggacggcugguacggguaccaccaccagaacgagcagggcagcggguacgccgccgaccagcaguccacccagaacgccaucaacggcaucacgaacaaggucaacagcgugaucgagaagaugaacacccaguucaccgccgucggcaaggaguucaacaagcuggagcggcgcauggagaaccugaacaagaagaucgacgacggguuccucgacaucuggaccuacaacgcggagcugcuggugcuccuggagaacgagcggacgcuggacuuccacgacuccaacgugaagaaccucuacgagaaggucaagucgcagcugaagaacaacgccaaggagaucggcaacgggugcuucgaguucuaccacaagugcaacgacgagugcauggaguccgugaagaacggcaccuacgacuaccccaaguacagcgaggagagcaagcugaaccgcgagaagaucgacggggugaagcucgaguccaugggcgucuacaacauccuggccaucuacagcaccguggccuccagccuggugcuccuggucucccugggcgccaucagcuucuggaugugcuccaacgggagccuccagugccggaucugcaucuga

SEQ ID NO: 6589 - RNA, 1698 nt, Artificial Sequence
  derived and/or modified CDS sequence (AUadapt) from InfluenzaA__ADV69085__HA
augaaggugaagcugaugguccuccugugcaccuucaccgccacguacgccgacaccaucugcgugggcuaccacgcgaacaacucgaccgacaccguggacacgguccuggagaagaacgugaccgugacccacuccgucaaccuccuggaggacagccacaacgggaagcugugccuccugaagggcaucgcgccccugcagcucggguccugcagcguggccggcuggauccuggggaacccggagugcgagcugcucaucuccaaggagagcugguccuacaucguggagacccccaaccccgagaacggcacgugcuaccccggcuacuucaccgacuacgaggagcugcgcgagcagcugagcuccgucagcuccuucaagcgguucgagaucuucccgaaggagucguccuggcccaaccacaccgugaccggggugagcuccagcugcucccacaacggcaagagcuccuucuaccgcaaccuccuguggcugacgaugaagaacgggcucuaccccaaccugagcaagagcuacaccaacaagaaggagaaggagguccuggugcucuggggcgugcaccaccccuccaacaucggggaccagcgggcccuguaccacaccgagaacgccuacgucagcgugguguccucgcacuacucccgccgguucaccccggagaucgccaagcgccccaagguccggaaccaggagggccgcaucaacuacuacuggacgcugcucgagcccggcgacaccaucaucuucgaggccaacgggaaccugaucgcgccccgguacgccuucgagcugagcaagggcuucggguccggcaucaucaccagcaacgccccgaugggcgagugcaacgccaagugccagacgccccagggggccaucaacuccagccuccccuuccagaacgugcaccccgugaccaucggcgagugcccgaaguacguccgcuccagcaagcugcggauggugaccgggcugcgcaacacccccuccauccagagccggggccucuucggggccaucgccggcuucaucgagggcggguggaccggcaugguggacgggugguacggcuaccaccaccagaacgagcagggguccggcuacgcggccgaccagcagagcacgcagaacgccaucaacggcaucaccaacaaggucaacuccgugaucgagaagaugaacacccaguucaccgccgucgggaaggaguucaacaagcuggagcgccggauggagaaccugaacaagaagaucgacgacggcuuccucgacaucuggacguacaacgccgagcugcuggugcuccuggagaacgagcgcacccuggacuuccacgacucgaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacagcgaggaguccaagcugaaccgggagaagaucgacggcgugaagcucgagagcaugggcgucuacaacauccuggccaucuacuccaccguggccagcucccuggugcuccuggucagccugggggccaucuccuucuggaugugcagcaacggcucccuccagugccgcaucugcaucuga

SEQ ID NO: 6590 - RNA, 1698 nt, Artificial Sequence
  derived and/or modified CDS sequence (AUadapt) from InfluenzaA__ADV69086__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcaacgucgccggcuggauccuggggaacccggagugcgagcuccugaucuccaaggagagcugguccuacaucguggagacccccaaccccgagaacggcacgugcuaccccggcuacuucaccgacuacgaggagcugcgcgagcagcucagcuccgugagcuccuucaagcgguucgagaucuucccgaaggagucguccuggcccaagcacaccgucaccggggugagcgccuccugcagccacaacggcaaguccagcuucuaccgcaaccugcuguggcucacggggaagaacggccuguaccccaaccuguccaagagcuacaccaacgacaaggagaaggaggugcucguccuguggggcgugcaccaccccuccaacaucggggaccagcgggcccuguaccacaaggagaacgccuacgugucggucgugagcucccacuacagccgccgguucaccccggagaucgugaagcgccccaagguccgggaccaggagggccgcaucaacuacuacuggacccuccuggagcccggggacacgaucaucuucgaggccaacggcaaccugaucgcgccccgguacgccuucgcccucucccgcggguucggcagcggcaucaucaccuccaacgccccgauggacgagugcaacaccaagugccagacgccccagggggccaucaacagcucccugcccuuccagaacgugcaccccgugaccaucggcgagugcccgaaguacgucaagucggccaagcugcggauggugaccgggcuccgcaacacccccuccauccagagccggggccuguucggggccaucgcgggcuucaucgagggcggguggaccggcaugguggacgggugguacggcuaccaccaccagaacgagcagggguccggcuacgccgccgaccagaaguccacgcagaacgccaucaacggcaucaccaacaaggucaacagcgugaucgagaagaugaacacccaguucaccgccgucgggaaggaguucaacaagcuggagcgccggauggagaaccucaacaagaagguggacgacggcuuccuggacaucuggacguacaacgcggagcugcucgugcugcuggagaacgagcgcacccucgacuuccacgacagcaacgucaagaaccuguacgagaaggugaagucccagcugaagaacaacgccaaggagaucgggaacggcugcuucgaguucuaccacaagugcaacgacgagugcauggagagcgugaagaacgggaccuacgacuaccccaaguacuccgaggagucgaagcucaaccgggagaagaucgacggcgucaagcuggaguccauggagguguaccagauccuggccaucuacagcaccguggccagcucccucgucuuccuggugagccugggcgccaucugcuucuggaugugcuccaacgggagccuccagugccgcaucugcaucuga

SEQ ID NO: 6591 - RNA, 1698 nt, Artificial Sequence
  derived and/or modified CDS sequence (AUadapt) from InfluenzaA__ADV69087__HA
augaaggugaagcugaugguccuccugugcaccuucaccgccacguacgccgacaccaucugcgugggcuaccacgcgaacaacucgaccgacaccguggacacgguccuggagaagaacgugaccgugacccacuccgucaaccuccuggaggacagccacaacgggaagcugugccuccugaagggcaucgcgccccugcagcucggguccugcagcguggccggcuggauccuggggaacccggagugcgagcugcucaucuccaaggagagcugguccuacaucguggagacccccaaccccgagaacggcacgugcuaccccggcuacuucaccgacuacgaggagcugcgcgagcagcugagcuccgucucguccuucaagcgguucgagaucuucccgaaggagagcuccuggcccaaccacaccgugaacggggugagcuccagcugcucccacaacggcgagagcuccuucuaccgcaaccuccuguggcugaccgucaaggacgggcucuaccccaaccugucgaagagcuacacgaacaagaaggagaaggaggugcuggugcucuggggcguccaccaccccuccaacaucggggaccagcgggcccuguaccacaccgagaacgccuacgugagcguggucuccagccacuacucccgccgguucaccccggagaucgccaagcgccccaaggugcggaaccaggagggccgcaucaacuacuacuggacccugcucgagcccggcgacacgaucaucuucgaggccaacgggaaccugaucgcgccccgguacgccuucgagcugagcaagggcuucggguccggcaucaucaccagcaacgccccgaugggcgagugcaacgccaagugccagacgccccagggggccaucaacuccucgcuccccuuccagaacgugcaccccgucaccaucggcgagugcccgaaguacgugcgcuccaccaagcugcggauggugaccgggcugcgcaacacccccagcauccagucccggggccucuucggggccaucgccggcuucaucgagggcggguggaccggcauggucgacgggugguacggcuaccaccaccagaacgagcaggggagcggcuacgcggccgaccagcaguccacgcagaacgccaucaacggcaucaccaacaaggugaacagcgucaucgagaagaugaacacccaguucaccgccguggggaaggaguucaacaagcuggagcgccggauggagaaccugaacaagaagaucgacgacggcuuccucgacaucuggacguacaacgccgagcugcuggugcuccuggagaacgagcgcacccuggacuuccacgacuccaacgucaagaaccucuacgagaaggucaagagccagcugaagaacaacgcgaaggagaucgggaacggcugcuucgaguucuaccacaagugcaacgacgagugcauggaguccgugaagaacgggaccuacgacuaccccaaguacucggaggagagcaagcugaaccgggagaagaucgacggcgugaagcucgaguccaugggcguguacaacauccuggccaucuacagcaccguggccuccagccugguccuccuggugucccugggggccaucagcuucuggaugugcuccaacggcagccuccagugccgcaucugcaucuga

SEQ ID NO: 6592 - RNA, 1698 nt, Artificial Sequence
  derived and/or modified CDS sequence (AUadapt) from InfluenzaA__ADV69088__HA
augaaggugaagcugcucauccugcugugcaccuucaccgccacguacgccgacaccaucugcaucggcuaccacgcgaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccgugaccggcuggauccuggggaacccggagugcgagcuccugaucagcaagaaguccuggagcuacaucgucgagacgcccaaccccgagaacggcgccugcuaccccggcuacuucgccgacuacgaggagcugcgcgagcagcucuccagcguguccagcuucgagcgguucgagaucuucccgaaggaguccagcuggcccaaccacaacgugaacggggucuccgccagcugcucccacaacggcaagagcuccuucuaccgcaaccugcuguggcucaccgggaagaacggccuguaccccucgcugaccaaguccuacgccaacgacaaggagaaggaggugcucauccuguggggcgugcaccaccccagcaacaucggggaccagcggacccuguaccacacggagaacgccuacgucagcgugauguccagccacuacucccgccgguucaccccggagaucagcaagcgccccaaggugcgggaccaggagggccgcaucaacuacuacuggacccuccuggagcccggggacaccaucaucuucgaggccaacggcaaccugaucgcccccugguacgcguucgcccucucccggggguucggcagcggcaucaucacguccagcgccccgauggacgccugcgacgccaagugccagacgccccagggggcgaucaacuccagccugcccuuccagaacguccaccccgugaccaucggcgagugcccgaaguacgugcgcuccaccaagcugcggauggucaccgggcuccgcaacauccccagcauccagucccggggccuguucggggccaucgccggcuucaucgagggcggguggaccggcaugguggacgggugguacggcuaccaccaccagaacgagcaggggucgggcuacgccgccgaccaggaguccacccagaacgcgcugcacggcaucaccaacaaggugaacagcgucaucgagaagaugaacacgcaguucaccgccguggggaaggaguucaacaagcucgagcgccggauggagaaccugaacaagaagguggacgacggcuuccuggacaucuggaccuacaacgccgagcuccugguccugcucgagaacgagcgcacccuggacuuccacgacuccaacgucaagagccuguacgagaaggugaagauccagcucaagaacaacgccaaggagaucgggaacggcugcuucgaguucuaccacaagugcaacaacgagugcauggaguccgugcggaacgggacguacgacuaccccaaguacagcgaggagagcaagcugaaccgcgagaagaucgacggcgugaagcuggacuccaugggcgucuaccagauccucgccaucuacagcaccguggcguccagccuggugcugcucgucucccugggggccaucagcuucuggaugugcuccaacggcagccugcagugccggaucugcaucuga

SEQ ID NO: 6593 - RNA, 1698 nt, Artificial Sequence
  derived and/or modified CDS sequence (AUadapt) from InfluenzaA__ADV69089__HA
augaaggugaagcugcucauccugcugugcaccuucaccgccacguacgccgacaccaucugcaucggcuaccacgcgaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaagaaguccuggagcuacaucgucgagacccccaaccccgagaacggcgccugcuaccccggcuacuucgccgacuacgaggagcugcgcgagcagcucuccagcguguccagcuucgagcgguucgagaucuucccgaaggaguccucguggcccaaccacaacgugaacggggucuccgccagcugcucccacaacggcaagagcuccuucuaccgcaaccugcuguggcucacggggaagaacggccuguaccccaaccugaccaagagcuacgccaacaacaaggagaaggaggugcucauccuguggggcgugcaccaccccuccaacaucggggaccagcggacccuguaccacaccgagaacgccuacgucagcgugaugagcucccacuacagccgccgguucacgccggagaucaccaagcgccccaagauccgggaccaggagggccgcaucaacuacuacuggacccuccuggagcccggggacaccaucaucuacgaggccaacggcaaccugaucgcgcccugguacgccuucgcccucucccggggguucggcucgggcaucaucacguccagcgccccgauggacgagugcgacgccaagugccagacgccccagggggcgaucaacuccagccugcccuuccagaacgugcaccccgucaccaucggcgagugcccgaaguacgugcgcuccgccaagcugcggauggugaccgggcuccgcaacauccccagcauccagucccggggccuguucggggccaucgccggcuucaucgagggcggguggaccggcauggucaacgggugguacggcuaccgccugcacaacgaccaggggagcggcuacgccgcggaccagaaguccacccagaacgcccucaacggcaucaccaacaaggugaacagcgugaucgagaagaugaacacccaguucacggccgucgggaaggaguucaacaagcuggagcggcgcauggagaaccugaacaagaagguggacgacggcuuccucgacaucuggaccuacaacgccgagaugcuggugcugcucgagaacgagcggacccuggacuuccacgacuccaacgucaagucgcuguacgagcgcgugaagauccagcucaagaacaacgccaaggagaucgggaacggcugcuucgaguucuaccacaagugcaacaacgagugcauggaguccguccggaacgggaccuacgacuaccccaaguacagcgaggaguccaagcugaaccgcgagaagaucgacggcgugaagcuggacagcaugggcguguaccagauccucgcgaucuacagcacggucgccuccagccuggugcugcucgugucccugggggccaucagcuucuggaugugcuccaacggcagccugcagugccggaucugcaucuga

SEQ ID NO: 6594 - RNA, 1698 nt, Artificial Sequence
  derived and/or modified CDS sequence (AUadapt) from InfluenzaA__ADV69090__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagagccucaucuccaaggagagcugguccuacaucguggagacccccaaccccgagaacggcacgugcuaccccggcuacuucgccgacuacgaggagcugcgcgagcagcugucguccgugagcuccuucgagcgguucgagaucuucccgaaggagagcuccuggcccaaccacaccgucaccggggugagcgccuccugcucgcacaacggcaaguccagcuucuaccgcaaccuccuguggcugacccggaagaacgggcucuaccccaaccuguccaagagcuacgccaacaacaaggagaaggaggugcugguccucuggggcgugcaccacccgcccaaccugggggaccagcgcgcccuguaccacacggagaacgccuacgugagcgucguguccagccacuacucccggcgcuucacccccgagaucgccaagcggcccaaggugcgcgaccaggagggccggaucaacuacuacuggacccuccuggagcccggcgacaccaucaucuucgaggcgaacgggaaccugaucgccccgcgcuucgccuucgcccucucgcggggcuucggguccggcaucaucacgagcaacgcccccauggacgagugcgacgcgaagugccagacgccccagggcgccaucaacuccagccugcccuuccagaacguccacccggugaccaucggggagugccccaaguacgugcgcuccaccaagcugcggauggucaccggccuccgcaacauccccagcauccagucccgggggcuguucggcgccaucgccggguucaucgagggcggcuggaccgggaugguggacggcugguacggguaccaccaccagaacgagcagggcucgggguacgccgcggaccagaaguccacccagaacgccaucaacggcaucaccaacaaggugaacagcgucaucgagaagaugaacacgcaguucaccgccgugggcaaggaguucaacaagcuggagcgccggauggagaaccucaacaagaaggucgacgacggguuccuggacaucuggaccuacaacgccgagcugcucgugcugcuggagaacgagcgcacccucgacuuccacgacuccaacgugaagaaccuguacgagaaggucaagagccagcugaagaacaacgccaaggagaucggcaacgggugcuucgaguucuaccacaagugcaacgacgagugcauggaguccgugaagaacggcacguacgacuaccccaaguacagcgaggaguccaagcucaaccgggagaagaucgacggggugaagcuggagucgaugggcgucuaccagauccuggcgaucuacagcaccguggccuccagccucgugcugcuggucucccucggcgccaucagcuucuggaugugcuccaacgggagccugcagugccgcaucugcaucuga

SEQ ID NO: 6595 - RNA, 1698 nt, Artificial Sequence
  derived and/or modified CDS sequence (AUadapt) from InfluenzaA__ADV69091__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcaacgucgccggcuggauccuggggaacccggagugcgagcuccugaucuccaaggagagcugguccuacaucguggagacccccaaccccgagaacggcacgugcuaccccggcuacuucaccgacuacgaggagcugcgcgagcagcucagcuccgugucguccuucaagcgguucgagaucuucccgaaggagagcuccuggcccaaccacaccgucaccggggugagcgccuccugcagccacaacggcaaguccagcuucuaccgcaaccugcuguggcucacgcggaagaacgggcuguaccccaaccuguccaagucguacaccaacgacaaggagaaggaggugcucguccuguggggcgugcaccaccccuccaacaucggggaccagcgcgcccuguaccacaaggagaacgccuacgugagcgucgugagcucccacuacagccggcgcuucaccccggagaucgugaagcggcccaagguccgcgaccaggagggccggaucaacuacuacuggacccuccuggagcccggcgacacgaucaucuucgaggccaacgggaaccugaucgcgccccgcuacgccuucgcccucucccggggcuucgggagcggcaucaucaccuccaacgccccgauggacgagugcaacaccaagugccagacgccccagggcgccaucaacucgucccugcccuuccagaacgugcaccccgugaccaucggggagugcccgaaguacgucaagagcgccaagcugcgcauggugaccggccuccggaacacccccuccauccagagccgcgggcuguucggcgccaucgcgggguucaucgagggcggcuggaccgggaugguggacggcugguacggguaccaccaccagaacgagcagggcuccggguacgccgccgaccagaaguccacgcagaacgccaucaacggcaucaccaacaaggucaacagcgugaucgagaagaugaacacccaguucaccgccgucggcaaggaguucaacaagcuggagcggcgcauggagaaccucaacaagaagguggacgacggguuccuggacaucuggacguacaacgcggagcugcucgugcugcuggagaacgagcggacccucgacuuccacgacagcaacgucaagaaccuguacgagaaggugaagaaccagcugaagaacaacgccaaggagaucggcaacgggugcuucgaguucuaccacaagugcaacgacgagugcauggaguccgugaagaacggcaccuacgacuaccccaaguacucggaggaguccaagcucaaccgcgagaagaucgacggggucaagcuggagagcauggagguguaccagauccuggccaucuacuccaccguggccagcagccucgucuuccuggugucccugggcgccaucugcuucuggaugugcagcaacggcucccuccagugccggaucugcaucuga

SEQ ID NO: 6596 - RNA, 1698 nt, Artificial Sequence
  derived and/or modified CDS sequence (AUadapt) from InfluenzaA__ADV69092__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcaacgucgccggcuggauccuggggaacccggagugcgagcuccugaucuccaaggagagcugguccuacaucguggagacccccaaccccgagaacggcacgugcuaccccggcuacuucaccgacuacgaggagcugcgcgagcagcucagcuccgugagcuccuucaagcgguucgagaucuucccgaaggagagcuccuggcccaaccacaccgucaccggggugucggccuccugcagccacaacggcaaguccagcuucuaccgcaaccugcuguggcucacggggaagaacggccuguaccccaaccuguccaagagcuacaccaacgacaaggagaaggaggugcucguccuguggggcgugcaccaccccuccaacaucggggaccagcgggcccuguaccacaaggagaacgccuacgugagcgucgugagcucccacuacucgcgccgguucaccccggagaucgugaagcgccccaagguccgggaccaggagggccgcaucaacuacuacuggacccuccuggagcccggggacacgaucaucuucgaggccaacggcaaccugaucgcgccccgguacgccuucgcccucucccgcggguucggcagcggcaucaucaccuccaacgccccgauggacgagugcaacaccaagugccagacgccccagggggccaucaacagcucccugcccuuccagaacgugcaccccgugaccaucggcgagugcccgaaguacgucaagagcgccaagcugcggauggugaccgggcuccgcaacacccuguccauccagagcaagggccuguucggggccaucgcgggcuucaucgagggcggguggaccggcaugguggacgggugguacggcuaccaccaccagaacgagcagggguccggcuacgccgccgaccagaaguccacgcagaacgccaucaacggcaucaccaacaaggucaacagcgugaucgagaagaugaacacccaguucaccgccgucgggaaggaguucaacaagcucgagcggcgcauggagaaccugaacaagaagguggacgacggcuuccuggacaucuggacguacaacgcggagcuccuggugcugcucgagaacgagcggacccuggacuuccacgacucgaacgucaagaaccuguacgagaaggugaagucccagcucaagaacaacgccaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgucaagcuggaguccauggagguguaccagauccucgccaucuacagcaccguggccagcucccuggucuuccuggugagccucggcgccaucugcuucuggaugugcuccaacgggagccugcagugccggaucugcaucuga

SEQ ID NO: 6597 - RNA, 1698 nt, Artificial Sequence
  derived and/or modified CDS sequence (AUadapt) from InfluenzaA__ADV69093__HA
augaaggugaagcugaugguccuccugugcaccuucaccgccacguacgccgacaccaucugcgugggcuaccacgcgaacaacucgaccgacaccguggacacgguccuggagaagaacgugaccgugacccacuccgucaaccuccuggaggacagccacaacgggaagcugugccuccugaagggcaucgcgccccugcagcucggguccugcagcguggccggcuggauccuggggaacccggagugcgagcugcucaucuccaaggagagcugguccuacaucguggagacccccaaccccgagaacggcacgugcuaccccggcuacgucaccgacuacgaggagcugcgcgagcagcugucguccgugagcuccuucaagcgguucgagaucuucccgaaggagagcuccuggcccaaccacaccgugaccggggucagcuccagcugcucccacaacggcaagucguccuucuaccgcaaccuccuguggcugacggugaagaacgggcucuaccccaaccugagcaagagcuacaccaacaagaaggagaaggaggugcugguccucuggggcgugcaccaccccuccaacaucggggaccagcgggcccuguaccacaccgagaacgccuacgugagcgucguguccucgcacuacucccgccgguucaccccggagaucgccaagcgccccaaggugcggaaccaggagggccgcaucaacuacuacuggacgcugcucgagcccggcgacaccaucaucuucgaggccaacgggaaccugaucgcgccccgguacgccuucgagcugagcaagggcuucggguccggcaucaucaccagcaacgccccgaugggcgagugcaacgccaagugccagacgccccagggggccaucaacuccagccuccccuuccagaacguccaccccgugaccaucggcgagugcccgaaguacgugaaguccgccaagcugcgcauggucaccgggcugcggaacacccccagcauccagucccgcggccucuucggggccaucgcgggcuucaucgagggcggguggaccggcaugguggacgggugguacggcuaccaccaccagaacgagcaggggucgggcuacgccgccgaccagcaguccacgcagaacgccaucaacggcaucaccaacaaggucaacagcgugaucgagaagaugaacacccaguucaccgccguggggaaggaguucaacaagcuggagcggcgcauggagaaccugaacaagcgggucgacgacggcuuccucgacaucuggacguacaacgcggagcugcuggugcuccuggagaacgagcgcacccuggacuuccacgacuccaacgugaagaaccucuacgagaaggucaagagccagcugaagaacaacgccaaggagaucgggaacggcugcuucgaguucuaccacaagugcaacgacgagugcauggaguccgugaagaacgggaccuacgacuaccccaaguacagcgaggagucgaagcugaaccgggagaagaucgacggcgugaagcucgaguccaugggcgucuacaacauccuggccaucuacagcaccguggccuccagccuggugcuccuggucucccugggggccaucagcuucuggaugugcuccaacggcagccuccagugccgcaucugcaucuga

SEQ ID NO: 6598 - RNA, 1698 nt, Artificial Sequence
  derived and/or modified CDS sequence (AUadapt) from InfluenzaA__ADV69094__HA
augaaggugaagcugaugguccuccugugcaccuucaccgccacguacgccgacaccaucugcgugggcuaccacgcgaacaacucgaccgacaccguggacacgguccuggagaagaacgugaccgugacccacuccgucaaccuccuggaggacagccacaacgggaagcugugccuccugaagggcaucgcgccccugcagcucggguccugcagcguggccggcuggauccuggggaacccggagugcgagcugcucaucuccaaggagagcugguccuacaucguggagacccccaaccccgagaacggcacgugcuaccccggcuacuucaccgacuacgaggagcugcgcgagcagcugagcuccgucagcuccuucaagcgguucgagaucuucccgaaggagucguccuggcccaaccacaccgugaccggggugagcuccagcugcucccacaacggcaagagcuccuucuaccgcaaccuccuguggcugacggucaagaacgggcucuaccccaaccugagcaagagcuacaccaacaagaaggagaaggaggugcuggugcucuggggcguccaccaccccuccaacaucggggaccagcgggcccuguaccacaccgagaacgccuacgugagcguggucuccucgcacuacucccgccgguucaccccggagaucgccaagcgccccaaggugcggaaccaggagggccgcaucaacuacuacuggacgcugcucgagcccggcgacaccaucaucuucgaggccaacgggaaccugaucgcgccccgguacgccuucgagcugagcaagggcuucggguccggcaucaucaccagcaacgccccgaugggcgagugcaacgccaagugccagacgccccagggggccaucaacuccagccuccccuuccagaacgugcaccccgucaccaucggcgagugcccgaaguacgugaaguccgccaagcugcgcauggugaccgggcugcggaacacccccagcauccagucccgcggccucuucggggccaucgcgggcuucaucgagggcggguggaccggcaugguccacgggugguacggcuaccaccaccagaacgagcaggggagcggcuacgccgccgagcagcaguccacgcaguacgccaucaacggcaucaccaacaaggugaacagcgucaucgagaagaugaacacccaguucaccgccguggggaaggaguucaacaagcuggagcggcgcauggagaaccugaacaagcggguggacgacggcuuccucgacaucuggacguacaacgcggagcugcugguccuccuggagaacgagcgcacccuggacuuccacgacuccaacgugaagaaccucuacgagaaggucaagucgcagcugaagaacaacgccaaggagaucgggaacggcugcuucgaguucuaccacaagugcaacgacgagugcauggaguccgugaagaacgggaccuacgacuaccccaaguacagcgaggagagcaagcugaaccgggagaagaucgacggcgugaagcucgaguccaugggcguguacaacauccuggccaucuacagcaccgucgccuccagccuggugcuccuggugucccugggggccaucagcuucuggaugugcuccaacggcagccuccagugccgcaucugcaucuga

SEQ ID NO: 6599 - RNA, 1698 nt, Artificial Sequence
  derived and/or modified CDS sequence (AUadapt) from InfluenzaA__ADV69095__HA
augaaggugaagcugaugguccuccugugcaccuucaccgccacguacgccgacaccaucugcgugggcuaccacgcgaacaacucgaccgacaccguggacacgguccuggagaagaacgugaccgugacccacuccgucaaccuccuggaggacagccacaacgggaagcugugccuccugaagggcaucgcgccccugcagcucggguccugcagcguggccggcuggauccuggggaacccggagugcgagcugcucaucuccaaggagagcugguccuacaucguggagccgcccaaccccgagaacgggaccugcuaccccggcuacuucacggacuacgaggagcugcgcgagcagcugagcuccgucucguccuucaagcgguucgagaucuuccccaaggagagcuccuggcccaaccacaccgugaacggcgugagcuccagcugcucccacaacggcgagagcuccuucuaccgcaaccuccuguggcugaccgucaaggacgggcucuaccccaaccugucgaagagcuacaccaacaagaaggagaaggaggugcuggugcucuggggcguccaccacccguccaacaucggggaccagcgggcccuguaccacacggagaacgccuacgugagcguggucuccagccacuacucccgccgguucacccccgagaucgccaagcgccccaaggugcggaaccaggagggccgcaucaacuacuacuggacccugcucgagcccggcgacaccaucaucuucgaggccaacgggaaccugaucgccccgcgguacgccuucgagcugagcaagggcuucggguccggcaucaucacgagcaacgcgcccaugggcgagugcaacgccaagugccagacgccccagggggccaucaacuccucgcuccccuuccagaacgugcacccggucaccaucggcgagugccccaaguacgugcgcuccaccaagcugcggauggugaccgggcugcgcaacacccccagcauccagucccggggccucuucggggccaucgccggcuucaucgagggcggguggaccggcauggucgacgggugguacggcuaccaccaccagaacgagcaggggagcggcuacgcggccgaccagcaguccacccagaacgccaucaacggcaucacgaacaaggugaacagcgucaucgagaagaugaacacccaguucaccgccguggggaaggaguucaacaagcuggagcgccggauggagaaccugaacaagaagaucgacgacggcuuccucgacaucuggaccuacaacgccgagcugcuggugcuccuggagaacgagcgcacgcuggacuuccacgacuccaacgucaagaaccucuacgagaaggucaagagccagcugaagaacaacgcgaaggagaucgggaacggcugcuucgaguucuaccacaagugcaacgacgagugcauggaguccgugaagaacgggaccuacgacuaccccaaguacucggaggagagcaagcugaaccgggagaagaucgacggcgugaagcucgaguccaugggcguguacaacauccuggccaucuacagcaccguggccuccagccugguccuccuggugucccugggggccaucagcuucuggaugugcuccaacggcagccuccagugccgcaucugcaucuga

SEQ ID NO: 6600 - RNA, 1698 nt, Artificial Sequence
  derived and/or modified CDS sequence (AUadapt) from InfluenzaA__ADV69096__HA
augaaggugaagcugaugguccuccugugcaccuucaccgccacguacgccgacaccaucugcgugggcuaccacgcgaacaacucgaccgacaccguggacacgguccuggagaagaacgugaccgugacccacuccgucaaccuccuggaggacagccacaacgggaagcugugccuccugaagggcaucgcgccccugcagcucggguccugcagcguggccggcuggauccuggggaacccggagugcgagcugcucaucuccaaggagagcugguccuacaucguggagacccccaaccccgagaacggcacgugcuaccccggcuacgucaccgacuacgaggagcugcgcgagcagcugucguccgugagcuccuucaagcgguucgagaucuucccgaaggagagcuccuggcccaaccacaccgugaccggggucagcuccagcugcucccacaacggcaagucguccuucuaccgcaaccuccuguggcugacggugaagaacgggcucuaccccaaccugagcaagagcuacaccaacaagaaggagaaggaggugcugguccucuggggcgugcaccaccccuccaacaucggggaccagcgggcccuguaccacaccgagaacgccuacgugagcgucguguccucgcacuacucccgccgguucaccccggagaucgccaagcgccccaaggugcggaaccaggagggccgcaucaacuacuacuggacgcugcucgagcccggcgacaccaucaucuucgaggccaacgggaaccugaucgcgccccgguacgccuucgagcugagcaagggcuucggguccggcaucaucaccagcaacgccccgaugggcgagugcaacgccaagugccagacccccaagggggccaucaacuccagccuccccuuccagaacguccaccccgugacgaucggcgagugcccgaaguacgugaaguccgccaagcugcgcauggucaccgggcugcggaacacccccagcauccagucccgcggccucuucggggccaucgcgggcuucaucgagggcggguggaccggcaugguggacgggugguacggcuaccaccaccagaacgagcaggggucgggcuacgccgccgaccagcaguccacgcagaacgccaucaacggcaucaccaacaaggucaacagcgugaucgagaagaugaacacccaguucaccgccguggggaaggaguucaacaagcuggagcggcgcauggagaaccugaacaagaaggucgacgacggcuuccucgacaucuggacguacaacgcggagcugcuggugcuccuggagaacgagcggacccuggacuuccacgaguccaacgugaagaaccucuacgagaaggucaagagccagcugaagaacaacgccaaggagaucgggaacggcugcuucgaguucuaccacaagugcaacgacgagugcauggaguccgugaagaacgggaccuacgacuaccccaaguacagcgaggagucgaagcugaaccgcgagaagaucgacggcgugaagcucgaguccaugggcgucuacaacauccuggccaucuacagcaccguggccuccagccuggugcuccuggucucccugggggccaucagcuucuggaugugcuccaacggcagccuccagugccggaucugcaucuga

SEQ ID NO: 6601 - RNA, 1698 nt, Artificial Sequence
  derived and/or modified CDS sequence (AUadapt) from InfluenzaA__ADV69097__HA
augaaggugaagcugcucauccugcugugcaccuucaccgccacguacgccgacaccaucugcaucggcuaccacgcgaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaagaaguccuggagcuacaucgucgagacccccaaccccggcaacggcgccugcuaccccggguacuucgccgacuacgaggagcugcgcgagcagcucuccagcguguccucguucgagcgguucgagaucuucccgaaggaguccagcugguccaaccacaacgugaacggcgucagcgccuccugcagccacaacgggaaguccagcuucuaccgcaaccugcuguggcucacgggcaagaacgggcuguaccccacccugaccaaguccuacgccaacgacaaggagaaggaggugcucauccuguggggcgugcaccaccccucgaacaucggcgaccagcggacccuguaccacacggagaacgccuacgucagcgugauguccagccacuacucccgccgguucacccccgagaucagcaagcgcccgaaggugcgggaccaggaggggcgcaucaacuacuacuggacccuccuggagcccggcgacaccaucaucuucgaggccaacgggaaccugaucgcgcccugguacgccuucgcccucucccggggcuucggcagcgggaucaucacguccaacgcccccauggacgagugcgacgccaagugccagaccccgcagggcgcgaucaacagcucccugcccuuccagaacauccaccccgucaccaucggggagugccccaaguacgugcgcucggccaagcugcggauggugaccggccuccgcaacacgccguccauccagagccgggggcuguucggcgccaucgccggcuucaucgagggcggguggaccgggauggucgacggcugguacggguaccaccaccagaacgagcagggcuccggcuacgccgcggaccaggagagcacccagaacgccaucaacgagaucaccaacaaggagaacuccgugaucgagaagaugaacacgcaguucaccagcguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacuccaacgucaagagccuguacgagaaggugaagauccagcugaagaacaacgccaaggagaucgggaacggcugcuucgaguucuaccacaagugcaacaacgagugcauggaguccgugcggaacgggacguacgacuaccccaaguacucggaggagagcaagcucaaccgcgagaagaucgacggcgucaagcuggacuccaugggcguguaccagauccuggccaucuacagcaccguggcguccagccucguccugcuggugucccucggggccaucagcuucuggaugugcuccaacggcagccugcagugccggaucugcaucuga

SEQ ID NO: 6602 - RNA, 1698 nt, Artificial Sequence
  derived and/or modified CDS sequence (AUadapt) from InfluenzaA__ADV69098__HA
augaaggugaagcugaucguccuccugugcaccuucaccgccacguacgccgacaccaucugcgugggcuaccacgcgaacaacucgaccgacaccguggacacgguccuggagaagaacgugaccgugacccacuccgucaaccuccuggaggacagccacaacgggaagcugugccuccugaagggcaucgcgccccugcagcucggguccugcagcguggccggcuggauccuggggaacccggagugcgagcugcucaucuccaaggagagcugguccuacaucguggagacccccaaccccgagaacggcacgugcuaccccggcuacuucaccgacuacgaggagcugcgcgagcagcugagcuccgucucguccuucaagcgguucgagaucuucccgaaggagagcuccuggcccaaccacaccgugaccggggugagcuccagcugcucccacaacggcaacagcuccuucuaccgcaaccuccuguggcugacggucaagaacgggcucuaccccaaccugucgaagagcuacaccaacaagaaggagaaggaggugcuggugcucuggggcguccaccaccccuccaacaucgaggaccagcgggcccuguaccacaccgagaacgccuacgugagcguggucuccagccacuacucccgccgguucaacccggagaucgccaagcgccccaaggugcggaaccaggaggggcgcaucaacuacuacuggacccugcucgagcccggcgacacgaucaucuucgaggccaacggcaaccugaucgcgccccgguacgccuucgagcugagcaagggguucggcuccgggaucaucaccucgaacgccccgaugggcgagugcaacgccaagugccagacgccccagggcgccaucaacuccaaccuccccuuccagaacgugcaccccgucaccaucggggagugcccgaaguacgugcgcagcgccaagcugcggauggugaccggccugcgcaacacccccuccauccagagccggggccucuucggggccaucgcgggguucaucgagggcggcuggaccgggauggucgacggcugguacggguaccaccaccacaacgagcagggcuccggguacgccgccaaccagaaguccacccccaacgccaucaacggcaucacgaacaaggugaacagcgucaucgagaagaugaacacccaguucaccgccgugggcaaggaguucaacaagcuggagcgccggauggagaaccugaacaagaagguggacgacggguuccucgacaucuggaccuacaacgcggagcugcugguccuccuggagaacgagcgcacgcuggacuuccacgacagcaacgugaagaaccucuacgagaaggugcggucccagcugaagaacaacgccaaggagaucggcaacgggugcuucgaguucuaccacaagugcaacgacgagugcauggagucggucaagaacggcaccuacgacuaccccaaguacuccgaggagagcaagcugaaccgcgagaagaucgacggggugaagcucgagagcaugggcguguacaacauccuggccaucuacuccaccgucgccagcucccuggugcuccuggugagccugggcgccaucuccuucuggaugugcagcaacgggucccuccagugccggaucugcaucuga

SEQ ID NO: 6603 - RNA, 1698 nt, Artificial Sequence
  derived and/or modified CDS sequence (AUadapt) from InfluenzaA__ADV69099__HA
augaaggugaagcugaucguccuccugugcaccuucaccgccacguacgccgacaccaucugcgugggcuaccacgcgaacaacucgaccgacaccguggacacgguccuggagaagaacgugaccgugacccacuccgucaaccuccuggaggacagccacaacgggaagcugugccuccugaagggcaucgcgccccugcagcucggguccugcagcguggccggcuggauccuggggaacccggagugcgagcugcucaucuccaaggagagcugguccuacaucguggagacccccaaccccgagaacggcacgugcuaccccggcuacuucaccgacuacgaggagcugcgcgagcagcugagcuccgucucguccuucaagcgguucgagaucuucccgaaggagagcuccuggcccaaccacaccgugaccggggugagcuccagcugcucccacaacggcaacagcuccuucuaccgcaaccuccuguggcugacggucaagaacgggcucuaccccaaccugucgaagagcuacaccaacaagaaggagaaggaggugcuggugcucuggggcguccaccaccccuccaacaucgaggaccagcgggcccuguaccacaccgagaacgccuacgugagcguggucuccagccacuacucccgccgguucaacccggagaucgccaagcgccccaaggugcggaaccaggaggggcgcaucaacuacuacuggacccugcucgagcccggcgacacgaucaucuucgaggccaacggcaaccugaucgcgccccgguacgccuucgagcugagcaagggguucggcuccgggaucaucaccucgaacgccccgaugggcgagugcaacgccaagugccagacgccccagggcgccaucaacuccaaccuccccuuccagaacgugcaccccgucaccaucggggagugcccgaaguacgugcgcagcgccaagcugcggauggugaccggccugcgcaacacccccuccauccagagccggggccucuucggggccaucgcgggguucaucgagggcggcuggaccgggauggucaacggcugguacggguaccaccaccacaacgagcagggcuccggguacgccgccaaccagcagagcccgcccaacgccaucaacggcaucaccaacaaggugaacuccgucaucgagaagaugaacacgcaguucaccgccgugggcaaggaguucaacaagcuggagcgccggauggagaaccugaacaagaagguggacgacggguuccucgacaucuggaccuacaacgcggagcugcugguccuccuggagaacgagcgcacccuggacuuccacgacagcaacgugaagaaccucuacgagaaggugcggucccagcugaagaacaacgccaaggagaucggcaacgggugcuucgaguucuaccacaagugcaacgacgagugcauggagucggucaagaacggcacguacgacuaccccaaguacuccgaggagagcaagcugaaccgcgagaagaucgacggggugaagcucgagagcaugggcguguacaacauccuggccaucuacuccaccgucgccagcucccuggugcuccuggugagccugggcgccaucuccuucuggaugugcagcaacgggucccuccagugccggaucugcaucuga

SEQ ID NO: 6604 - RNA, 1698 nt, Artificial Sequence
  derived and/or modified CDS sequence (AUadapt) from InfluenzaA__ADV69100__HA
augaaggugaagcugcucauccugcugugcaccuucaccgccacguacgccgacaccaucugcaucggcuaccacgcgaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagagccucaucuccaagaaguccuggucguacaucgucgagacccccaagcccgagaacggcacgugcuaccccggcgaguucgccgacuacgaggagcugcgcgagcagcugagcuccgugagcuccuucgagcgguucgagaucuucccgaaggagucguccuggcccaaccacaccgccgccggggugagcgccuccugcagccacaacggcgagcgcuccuucuacaagaaccucaucuggcugaccgucaagaacgggcuguaccccaaccucucgaaguccuacaagaacgacaaggagaaggaggugcugauccuguggggcgugcaccacccgcccaacaucgagaaccagcggacccucuaccacacggagaacaccuacgucagcguggugagcucccacuacagcgggcgcuucacccccgagaucaccaagcggcccaagguccgcgaccaggagggccggaucaacuacuacuggacgcugcuggagcccggcgacaccaucaucuucgaggccaacgggaaccucaucgccccgugguacgcguucacccugucccgcggccuggggucgggcaucgugaccuccaacgcccccauggacaagugcgacgccaagugccagacgccccacggcgccaucaacagcucccuccccuuccagaacgugcacccggucaccaucggggagugccccaaguacgugcggagcgccaagcugcgcauggugaccggccugcggaacauccccuccauccagucgcgcggccucuucggggcgaucgccggguucaucgagggcggcuggaccgggauggucgacggcugguacggguaccaccaccagaacgagcagggcuccggguacgccgccgaccaggagagcacgcagaacgccaucaacggcaucaccaacaaggugaacuccgugaucgagaagaugaacacccaguucaccgcggucggcaaggaguucaacaagcuggagcggcgcauggagaaccugaacaagaagguggacgacggguuccucgacaucuggacguacaacgccgagcugcugguccuccuggagaacgagcggacccuggacuuccacgacagcaacgugaagucccucuacgagaaggucaagucgcagcugaagaacaacgccaaggagaucggcaacgggugcuucgaguucuaccacaagugcaacaacgagugcauggaguccgugaagaacggcaccuacgacuaccccaaguacagcgaggaguccaagcugaaccgcgagaagaucgacggggugaagcucgacagcaugggcguguaccggauccuggccaucuacucgaccgucgccuccagccuggugcuccuggugucccugggcgcgaucagcuucuggaugugcuccaacgggagccuccagugccgcaucugcaucuga

SEQ ID NO: 6605 - RNA, 1698 nt, Artificial Sequence
  derived and/or modified CDS sequence (AUadapt) from InfluenzaA__ADV69101__HA
augaaggugaagcugcucauccuguucugcaccuucaccgccacguacgccgacaccaucugcaucggcuaccacgcgaacaacucgaccgacaccgucgacacggugcuggagaagaacgugaccgucacccacuccgugaaccuccuggaggacagccacaacgggaagcugugccuccugaagggcaucgcgccccugcagcucgggaacugcuccguggccggcuggauccuggggaacccggagugcgagagccugaucuccaagaaguccuggagcuacaucgucgagacccccaaccccgagaacggcgccugcuaccccggcgaguucgccgacuacgaggagcuccgcgagcagcugucguccgugagcuccuucgagcgguucgagaucuucccgaaggagagcuccuggcccaaccacacggccaccggggugagcgccuccugcucgcacaacggcgagcgcuccuucuaccggaaccugaucuggcucaccgucaagaacgggcuguaccccaaccugagcaaguccuacgagaacgacaaggagaaggaggugcucauccuguggggcgugcaccacccgcccaacaucgagaaccagcgcacccuguaccacacggagaacgccuacgucagcguggugagcucccacuacagcgggcgguucacccccgagaucaccaagcgccccaagguccgggaccaggagggccgcaucaacuacuacuggacccuccuggagcccggcgacacgaucaucuucgaggccaacgggaaccugaucgcgccgugguacgccuucacccucucccggggccuggggucgggcaucaucaccuccaacgcccccauggacgagugcgacagcaagugccagacgccccagggcgccaucaacuccagccugcccuuccagaacgugcacccggugaccaucggggagugccccaaguacguccgcuccgccaagcuccggauggugaccggccugcgcaacauccccagcauccagucccgggggcuguucggcgcgaucgccggguucaucgagggcggcuggaccgggaugguggacggcugguacggguaccaccaccagaacgagcagggcucgggguacgccgccgaccaggaguccacccagaacgccaucaacggcaucacgaacaaggucaacagcgugaucgagaagaugaacccccaguucaccgcggugggcaaggaguucaacaagcucgagcgccggauggagaaccugaacaagaaggucgacgacggguuccuggacaucuggaccuacaacgccgagcuccuggugcugcucgagaacgagcgcacccuggacuuccacgacuccaacgucaagagccuguacgagaaggugaagucccagcucaagaacaacgccaaggagaucggcaacgggugcuucgaguucuaccacaagugcaacaacgagugcauggagagcgugaagaacggcacguacgacuacccgaaguacuccgaggagucgaagcugaaccgggagaagaucgacggggucaagcuggacagcaugggcguguaccgcauccucgccaucuacuccaccguggccagcucccugguccugcucgugagccugggcgcgaucuccuucuggaugugcagcaacgggucccugcagugccggaucugcaucuga

SEQ ID NO: 6606 - RNA, 1698 nt, Artificial Sequence
  derived and/or modified CDS sequence (AUadapt) from InfluenzaA__ADV69102__HA
augaaggugaagcugcucauccuguucugcaccuucaccgccacguacgccgacaccaucugcaucggcuaccacgcgaacaacucgaccgacaccgucgacacggugcuggagaagaacgugaccgucacccacuccgugaaccuccuggaggacagccacaacgggaagcugugccuccugaagggcaucgcgccccugcagcucgggaacugcuccguggccggcuggauccuggggaacccggagugcgagagccugaucuccaagaaguccuggagcuacaucgucgagacccccaaccccgagaacggcgccugcuaccccggcgaguucgccgacuacgaggagcuccgcgagcagcugucguccgugagcuccuucgagcgguucgagaucuucccgaaggagagcuccuggcccaaccacacggccaccggggugagcgccuccugcucgcacaacggcgagcgcuccuucuaccggaaccugaucuggcucaccgucaagaacgggcuguaccccaaccugagcaaguccuacgagaacgacaaggagaaggaggugcucauccuguggggcgugcaccacccgcccaacaucgagaaccagcgcacccuguaccacacggagaacgccuacgucagcguggugagcucccacuacagcgggcgguucacccccgagaucaccaagcgccccaagguccgggaccaggagggccgcaucaacuacuacuggacccuccuggagcccggcgacacgaucaucuucgaggccaacgggaaccugaucgcgccgugguacgccuucacccucuccaccggccuggggucgggcaucaucaccuccaacgcccccauggacgagugcgacagcaagugccagacgccccagggcgccaucaacuccagccugcccuuccagaacgugcacccggugaccaucggggagugccccaaguacguccgguccgccaagcuccgcauggugaccggccugcggaacauccccagcauccagucccgcgggcuguucggcgcgaucgccggguucaucgagggcggcuggaccgggaugguggacggcugguacggguaccaccaccagaacgagcagggcucgggguacgccgccgaccaggaguccacgcagaacgccaucaacggcaucaccaacaaggucaacagcgugaucgagaagaugaacacccaguucaccgcggugggcaaggaguucaacaagcucgagcggcgcauggagaaccugaacaagaaggucgacgacggguuccuggacaucuggacguacaacgccgagcuccuggugcugcucgagaacgagcggacccuggacuuccacgacuccaacgucaagagccuguacgagaaggugaagucccagcucaagaacaacgccaaggagaucggcaacgggugcuucgaguucuaccacaagugcaacaacgagugcauggagagcgugaagaacggcaccuacgacuaccccaaguacuccgaggagucgaagcugaaccgcgagaagaucgacggggucaagcuggacagcaugggcguguaccggauccucgccaucuacuccaccguggccagcucccugguccugcucgugagccugggcgcgaucuccuucuggaugugcagcaacgggucccugcagugccgcaucugcaucuga

SEQ ID NO: 6607 - RNA, 1698 nt, Artificial Sequence
  derived and/or modified CDS sequence (AUadapt) from InfluenzaA__ADV69103__HA
augaaggugaagcugaugguccuccugugcaccuucaccgccacguacgccgacaccaucugcgugggcuaccacgcgaacaacucgaccgacaccguggacacgguccuggagaagaacgugaccgugacccacuccgucaaccuccuggaggacagccacaacgggaagcugugccuccugaagggcaucgcgccccugcagcucggguccugcagcguggccggcuggauccuggggaacccggagugcgagcugcucaucuccaaggagagcugguccuacaucguggagacccccaaccccgagaacggcacgugcuaccccggcuacuucaccgacuacgaggagcugcgcgagcagcugagcuccgucucguccuucaagcgguucgagaucuucccgaaggagagcuccuggcccaaccacaacgugaccggggugagcuccagcugcucccacaacggcaagagcuccuucuaccgcaaccuccuguggcugaccgucaagaacgggcucuaccccaaccugucgaagagcuacacgaacaagaaggagaaggaggugcuggugcucuggggcguccaccaccccuccaacaucggggaccagcgggcccuguaccacaccgagaacgccuacgugagcguggucuccagccacuacucccgccgguucaccccggagaucgccaagcgccccaaggugcggaaccaggagggccgcaucaacuacuacuggacccugcucgagcccggcgacacgaucaucuucgaggccaacgggaaccugaucgcgccccgguacgccuucgagcugagcaagggcuucggguccggcaucaucaccagcaacgccccgaucggcgagugcaacgccaagugccagacgccccagggggccaucaacuccucgcuccccuuccagaacgugaaccccgucaccaucggcgagugcccgaaguacgugaaguccgccaagcugcgcauggugaccgggcugcggaacacccccagcauccagucccgcggccucuucggggccaucgcgggcuucaucgagggcggguggaccggcauggucgacgggugguacggcuaccaccaccagaacgagcaggggagcggcuacgccgccgaccagcaguccacccagaacgccaucaacggcaucacgaacaaggugaacagcgucaucgagaagaugaacacccaguucaccgccguggggaaggaguucaacaagcuggagcggcgcauggagaaccugaacaagaagguggacgacggcuuccucgacaucuggaccuacaacgcggagcugcugguccuccuggagaacgagcggacgcuggacuuccacgacuccaacgugaagaaccucuacgagaaggucaagagccagcugaagaacaacgccaaggagaucgggaacggcugcuucgaguucuaccacaagugcaacgacgagugcauggaguccgugaagaacgggaccuacgacuaccccaaguacucggaggagagcaagcugaaccgcgagaagaucgacggcgugaagcucgaguccaugggcguguacaacauccuggccaucuacagcaccgucgccuccagccuggugcuccuggugucccugggggccaucagcuucuggaugugcuccaacggcagccuccagugccggaucugcaucuga

SEQ ID NO: 6608 - RNA, 1698 nt, Artificial Sequence
  derived and/or modified CDS sequence (AUadapt) from InfluenzaA__ADV69104__HA
augaaggugaagcugcucauccuguucugcaccuucaccgccacguacgccgacaccaucugcaucggcuaccacgcgaacaacucgaccgacaccgucgacacggugcuggagaagaacgugaccgucacccacuccgugaaccuccuggaggacagccacaacgggaagcugugccuccugaagggcaucgcgccccugcagcucgggaacugcuccguggccggcuggauccuggggaacccggagugcgagagccugaucuccaagaaguccuggagcuacaucgucgagacccccaaccccgagaacggcgccugcuaccccggcgaguucgccgacuacgaggagcuccgcgagcagcugucguccgugagcuccuucgagcgguucgagaucuucccgaaggagagcuccuggcccaaccacacggccaccggggugagcgccuccugcucgcacaacggcgagcgcuccuucuaccggaaccugaucuggcucaccgucaagaacgggcuguaccccaaccugagcaaguccuacgagaacgacaaggagaaggaggugcucauccuguggggcgugcaccacccgcccaacaucgagaaccagcgcacccuguaccacacggagaacgccuacgucagcguggugagcucccacuacagcgggcgguucacccccgagaucaccaagcgccccaagguccgggaccaggagggccgcaucaacuacuacuggacccuccuggagcccggcgacacgaucaucuucgaggccaacgggaaccugaucgcgccgugguacgccuucacccucucccggggccuggggucgggcaucaucaccuccaacgcccccauggacgagugcgacagcaagugccagacgccccagggcgccaucaacuccagccugcccuuccagaacgugcacccggugaccaucggggagugccccaaguacguccgcuccgccaagcuccggauggugaccggccugcgcaacauccccagcauccagucccgggggcuguucggcgcgaucgccggguucaucgagggcggcuggaccgggaugguggacggcugguacggguaccaccaccagaacgagcagggcucgggguacgccgccgaccaggaguccacccagaacgccaucaacggcaucacgaacaaggucaacagcgugaucgagaagaugaacacccaguucaccgcggugggcaaggaguucaacaagcucgagcgccggauggagaaccugaacaagaaggucgacgacggguuccuggacaucuggaccuacaacgccgagcuccuggugcugcucgagaacgagcgcacgcuggacuuccacgacuccaacgucaagagccuguacgagaaggugaagucccagcucaagaacaacgccaaggagaucggcaacgggugcuucgaguucuaccacaagugcaacaacgagugcauggagagcgugaagaacggcaccuacgacuaccccaaguacuccgaggagucgaagcugaaccgggagaagaucgacggggucaagcuggacagcaugggcguguaccgcauccucgccaucuacuccaccguggccagcucccugguccugcucgugagccugggcgcgaucuccuucuggaugugcagcaacgggucccugcagugccggaucugcaucuga

SEQ ID NO: 6609 - RNA, 1698 nt, Artificial Sequence
  derived and/or modified CDS sequence (AUadapt) from InfluenzaA__ADV69105__HA
augaaggugaagcugcucauccugcugugcaccuucaccgccacguacgccgacaccaucugcaucggcuaccacgcgaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagagccucaucuccaagaaguccuggucguacaucgucgagacccccaaccccgagaacggcgccugcuaccccggcgaguucgccgacuacgaggagcugcgcgagcagcugagcuccgugagcuccuucgagcgguucgagaucuucccgaaggagucguccuggcccaaccacacggccgccggggugagcgccuccugcagccacaacggcgagcgcuccuucuaccggaaccucaucuggcugaccgucaagaacgggcuguaccccaaccucucgaaguccuacaagaacgacaaggagaaggaggugcugaucaucuggggcgugcaccacccgcccaacaucgagaaccagcgcacccuguaccacaccgagaacgccuacgucagcguggugagcucccacuacagcgggcgguucacgcccgagaucaccaagcgccccaagguccgggaccaggagggccgcaucaacuacuacuggacccuccuggagcccggcgacaccaucaucuucgaggcgaacgggaaccugaucgccccgugguacgccuucacgcucucccggggccuggggucgggcaucaucaccuccaacgcccccauggacgagugcgacgccaagugccagacgccccagggcgcgaucaacagcucccugcccuuccagaacgugcacccggugaccaucggggagugccccaaguacguccgcagcgccaagcuccggauggugaccggccugcgcaacauccccuccauccagucgcgggggcuguucggcgccaucgccggguucaucgagggcggcuggaccgggaugguggacggcugguacggguaccaccaccagaacgagcagggcuccggguacgccgcggaccaggagagcacccagaacgccaucaacggcaucaccaacaaggucaacuccgugaucgagaagaugaacacgcaguucaccgccgugggcaaggaguucaacaagcucgagcgccggauggagaaccugaacaagaaggucgacgacggguuccuggacaucuggaccuacaacgccgagcuccuggugcugcucgagaacgagcgcacccuggacuuccacgacagcaacgucaagucccuguacgagaaggucaagucgcagcucaagaacaacgccaaggagaucggcaacgggugcuucgaguucuaccacaagugcaacaacgagugcauggaguccgugaagaacggcacguacgacuaccccaaguacagcgaggaguccaagcugaaccgggagaagaucgacggggugaagcuggacagcaugggcguguaccgcauccucgcgaucuacucgaccguggccuccagccugguccugcucgugucccugggcgccaucagcuucuggaugugcuccaacgggagccugcagugccggaucugcaucuga

SEQ ID NO: 6610 - RNA, 1698 nt, Artificial Sequence
  derived and/or modified CDS sequence (AUadapt) from InfluenzaA__ADV69106__HA
augaaggugaagcugcucauccugcugugcaccuucaccgccacguacgccgacaccaucugcaucggcuaccacgcgaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagagccucaucuccaagaaguccuggagcuacaucgucgagacccccaaccccggcaacggcgccugcuaccccggguacuucgccgacuacgaggagcugcgcgagcagcugagcuccgugagcuccuucgagcgguucgagauguucccgaaggagucguccuggcccaaccacaacgugaacggcgucagcgccuccugcagccacaacgggaaguccagcuucuaccgcaaccuccuguggcugacgcggaagaacggccucuaccccaaccugaccaaguccuacgccaacaacaacgacaaggaggugcugauccucuggggcgugcaccaccccagcaacaucggggaccagcgcacccuguaccacaccgagaacgccuacgucagcgugauguccagccacuacucccggcgcuucacgccggagaucaccaagcggcccaaggugcgcgaccaggagggccggaucaacuacuacuggacccugcucgagcccggggacaccaucaucuucgaggccaacggcaaccugaucgcgcccugguacgccuucgcccugucgcgcuccuucgggagcggcaucaucacguccagcgccccgauggacgagugcgacgccaagugccagacgccccagggcgcgaucaacuccagccuccccuuccagaacguccaccccgugaccaucggggagugcccgaaguacgugcgguccgccaagcugaagauggucaccggccugcgcaacauccccagcauccagucccggggccucuucggggccaucgccggguucaucgagggcggcuggaccgggaugguggacggcugguacggguaccaccaccagaacgagcagggcagcggguacgccgcggaccaggaguccacccagaacgccaucaacggcaucaccaacaaggugaacagcgucaucgagaagaugaacacccaguucacggccgugggcaaggaguucaacaagcuggagaagcgcauggagaaccugaacaagaagguggacgacggguuccucgacaucuggaccuacaacgccgagcugcugguccuccuggagaacgagcggacccuggacuuccacgacuccaacgucaagucgcucuacgagaaggugaagauccagcugaagaacaacgccaaggagaucggcaacgggugcuucgaguucuaccacaagugcaacaacgagugcauggaguccgugcgcaacggcaccuacgacuaccccaaguacagcgaggagagcaagcugaaccgggagaagaucgacggggugaagcucgacuccaugggcgucuaccagauccuggcgaucuacagcacgguggccuccagccuggugcuccuggucucccugggcgccaucagcuucuggaugugcuccaacgggagccuccagugccgcaucugcaucuga

SEQ ID NO: 6611 - RNA, 1698 nt, Artificial Sequence
  derived and/or modified CDS sequence (AUadapt) from InfluenzaA__ADV69107__HA
augaaggugaagcugcucauccugcugugcaccuucaccgccacguacgccgacaccaucugcaucggcuaccacgcgaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagagccucaucuccaaggagucgugguccuacaucgucgagacccccaacagcgacaacggcgccugcuaccccggccaguucacggacuacgaggagcugcgcgagcagcuguccagcguguccagcuucgagcgguucgagaucuuccccaaggaguccucguggccgaaccacaccgugaccggggucuccgccagcugcucccacaacggcgagcgcagcuucuaccggaaccucaucuggcugaccgugaagaacgggcuguaccccaaccucuccaagagcuacgagaacgacaaggagaaggaggugcugauccuguggggcguccaccacccgcccaacaucggggaccagcgcacgcucuaccacaccgagaacgccuacaucucggugguguccagccacuacuccggccgguucacccccgagaucaccaagcgccccaagguccgggaccaggagggccgcaucaacuacuacuggacgcugcuggagcccggggacaccaucaucuucgaggccaacggcaaccucaucgcccccugguacgccuucgcgcugagccgggggcugggcuccggcaucaucaccucgaacgccccgauggacaagugcgacgccaagugccagacgccccagggggccaucaacuccagccuccccuuccagaacgugcaccccgugaccaucggcgagugcccgaaguacguccgcuccaccaagcugcggauggugaccgggcugcgcaacauccccagcauccagucccggggccucuucggggccaucgcgggcuucaucgagggcggguggaccggcaugguggacgggugguacggcuaccaccaccagaacgagcaggggagcggcuacgccgccgaccaggaguccacgcagaacgccaucaacggcaucaccaacaaggucaacucggugaucgagaagaugaacacccaguucaccgccguggggaaggaguucaacaagcuggagcgccggauggagaaccugaacaagaaggucgacgacggcuuccucgacaucuggacguacaacgcggagcugcuggugcuccuggagaacgagcgcacccuggacuuccacgacuccaacgucaagagccucuacgagaaggugaagucccagcugaagaacaacgccaaggagaucgggaacggcugcuucgaguucuaccacaagugcaacaacgagugcauggagagcgugcggaacgggaccuacgacuaccccaaguacuccgaggagagcaagcugaaccgcgagaagaucgacggcgucaagcucgacucgaugggcguguaccggauccuggccaucuacuccaccgccgccagcucccuggugcuccuggucagccugggggcgaucuccuucuggaugugcagcaacggcucccuccagugccgcaucugcaucuga

SEQ ID NO: 6612 - RNA, 1698 nt, Artificial Sequence
  derived and/or modified CDS sequence (AUadapt) from InfluenzaA__ADV69108__HA
augaaggugaagcugcucguccugcugugcaccuucaccgccacguacgccgacaccaucugcgugggcuaccacgcgaacaacucgaccgacaccguggacacgguccucgagaagaacgugaccgugacccacuccgucaaccugcuggaggacagccacaacgggaagcucugccugcugaagggcaucgcgccccuccagcugggguccugcagcguggccggcuggauccuggggaacccggagugcgagcuccugaucuccaaggagagcugguccuacaucguggagacccccaaccccgagaacggcacgugcuaccccggcuacuucaccgacuacgaggagcugcgcgagcagcucagcuccgucagcuccuucaagcgguucgagaucuucccgaaggagucguccuggcccaaccacaccgugaccggggugagcuccagcugcucccacaacggcaagagcuccuucuaccgcaaccugcuguggcucacgaugaagaacgggcuguaccccaaccugagcaagagcuacaccaacaagaaggagaaggagguccucgugcuguggggcgugcaccaccccuccaacaucggggaccagcgggcccuguaccacaccgagaacgccuacgucagcgugguguccucgcacuacucccgccgguucaccccggagaucgccaagcgccccaagguccggaaccaggagggccgcaucaacuacuacuggacgcuccuggagcccgaggacaccaucaucuucgaggccaacggcaaccugaucgcgccccgguacgccuucgagcucagcaagggguucggcuccgggaucaucaccagcaacgccccgaugggcgagugcaacgccaagugccagacgccccagggcgccaucaacuccagccugcccuuccagaacgugcaccccgugaccaucggggagugcccgaaguacguccgcuccagcaagcugcggauggugaccggccuccgcaacacccccuccauccagagccgggggcuguucggcgccaucgccggguucaucgagggcggcuggaccgggaugguggacggcugguacggguaccaccaccagaacgagcagggcuccggguacgcggccgaccagcagagcacgcagaacgccaucaacggcaucaccaacaaggucaacuccgugaucgagaagaugaacacccaguucaccgccgucggcaaggaguucaacaagcuggagcgccggauggagaaccucaacaagaagaucgacgacggguuccuggacaucuggacguacaacgccgagcugcucgugcugcuggagaacgagcgcacccucgacuuccacgacucgaacgugaagaaccuguacgagaaggucaagucccagcugaagaacaacgcgaaggagaucggcaacgggugcuucgaguucuaccacaagugcaacgacgagugcauggagagcgugaagaacggcaccuacgacuaccccaaguacagcgaggaguccaagcucaaccgggagaagaucgacggggugaagcuggagagcaugggcgucuacaacauccuggccaucuacuccaccguggccagcucccucgugcugcuggucagccucggcgccaucuccuucuggaugugcagcaacgggucccugcagugccgcaucugcaucuga

SEQ ID NO: 6613 - RNA, 1698 nt, Artificial Sequence
  derived and/or modified CDS sequence (AUadapt) from InfluenzaA__ADV69109__HA
augaaggugaagcugcucauccugcugugcaccuucaaggccaccuacgccgacacgaucugcaucggcuaccacgcgaacaacucgaccgagaccgucgacaccgugcucgagaagaacgugacggucacccacuccgugaaccugcuggaggacagccacaacgggaagcucugccugcugaagggcaucgcgccccuccagcuggggaacugcuccguggccggcuggauccuggggaacccggagugcgagagccucaucuccaagaaguccuggucguacaucgucgagacccccaaccccgagaacggcgccugcuaccccggcgaguucgccgacuacgaggagcugcgcgagcagcugagcuccgugagcuccuucgagcgguucgagaucuucccgaaggagucguccuggcccaaccacaccgccacgggggugagcgccuccugcagccacaacggcgagcgcuccuucuaccggaaccucaucuggcugaccgucaagaacgggcuguaccccaaccucucgaaguccuacgagaacgacaagaagaaggaggugcugauccuguggggcgugcaccacccgcccaacaucgagaaccagcgcacccucuaccacaccgagaacgccuacgucagcguggugagcucccacuacagcgggcgguucacgcccgagaucaccaagcgccccaagguccgggaccaggagggccgcaucaacuacuacuggacccugcuggagcccggcgacaccaucaucuucgaggccaacgggaaccucaucgcgccgugguacgccuucacgcugucccggggccuggggucgggcaucaucaccuccaacgcccccauggacgagugcgacgccaagugccagacccccaagggcgccaucaacagcucccuccccuuccagaacgugcacccggugaccaucggggagugccccaaguacguccgcagcgcgaagcugcggauggugacgggccugcgcaacauccccuccauccagucgcggggccucuucggggccaucgccggguucaucgagggcggcuggaccgggaugguggacggcugguacggguaccaccaccagaacgagcagggcuccggguacgccgccgaccaggagagcacccagaacgcgaucaacggcaucaccaacaaggucaacuccgugaucgagaagaugaacacgcaguucaccgccgugggcaaggaguucaacaagcuggagcgccggauggagaaccugaacaagaaggucgacgacggguuccucgacaucuggaccuacaacgccgagcugcuggugcuccuggagaacgagcgcacccuggacuuccacgacagcaacgucaagucccucuacgagaaggucaagucgcagcugaagaacaacgccaaggagaucggcaacgggugcuucgaguucuaccacaagugcaacaacgagugcauggaguccgugaagaacggcacguacgacuaccccaaguacagcgaggaguccaagcugaaccgggagaagaucgacggggugaagcucgacagcaugggcguguaccgcauccuggccaucuacucgaccguggcguccagccugguccuccuggugucccugggcgccaucagcuucuggaugugcuccaacgggagccuccagugccggaucugcaucuga

SEQ ID NO: 6614 - RNA, 1701 nt, Artificial Sequence
  derived and/or modified CDS sequence (AUadapt) from InfluenzaA__ADV76579__HA
augaagaccaucaucgcccugucguacauccucugccugguguucgcccagaagcugcccggcaacgacgacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcaccuccgguucaaguaccccgcccugaacgugaccaugcccaacaacgagcaguucgacaagcuguacaucuggggcguccaccaccccgggaccgacaacgaccagaucuuccuguacgcgcaggccucggggcgcaucaccguguccacgaagcggagccagcagaccgugaucccgaacaucggcucgcgcccccggguccgcaacauccccucccggaucagcaucuacuggaccaucgugaagcccggcgacauccugcucaucaacuccaccgggaaccugaucgccccgcgcggcuacuucaagauccggucggggaaguccucgaucaugcgcuccgacgcccccaucggcaagugcaacagcgagugcaucacgcccaacggcuccauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggguucaucgagaacggcugggagggcaugguggacgggugguacggcuuccggcaccagaacucggaggggcgcggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgcgagaacgccgaggacauggggaacggcugcuucaagaucuaccacaagugcgacaacgcgugcaucggguccauccggaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 6615 - RNA, 1701 nt, Artificial Sequence; identical to SEQ ID NO: 3833
  derived and/or modified CDS sequence (AUadapt) from InfluenzaA__ADV76587__HA

SEQ ID NO: 6616 - RNA, 1701 nt, Artificial Sequence; identical to SEQ ID NO: 3833
  derived and/or modified CDS sequence (AUadapt) from InfluenzaA__ADV76598__HA

SEQ ID NO: 6617 - RNA, 1701 nt, Artificial Sequence; identical to SEQ ID NO: 3656
  derived and/or modified CDS sequence (AUadapt) from InfluenzaA__ADV76609__HA

SEQ ID NO: 6618 - RNA, 1701 nt, Artificial Sequence; identical to SEQ ID NO: 3833
  derived and/or modified CDS sequence (AUadapt) from InfluenzaA__ADV76620__HA

SEQ ID NO: 6619 - RNA, 1701 nt, Artificial Sequence
  derived and/or modified CDS sequence (AUadapt) from InfluenzaA__ADV76631__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaagaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccucggggcggaucaccguguccacgaagcgcagccagcagaccgugaucccgaacaucggcucgcggccccgcguccggaacauccccucccgcaucagcaucuacuggaccauggugaagcccggcgacauccugcucaucaacuccaccgggaaccugaucgccccgcggggcuacuucaagauccgcucggggaaguccucgaucaugcgguccgacacgcccaucggcaagugcaacagcgagugcaucacccccaacggcuccauccccaacgacaagccguuccagaacgugaaccgcaucaccuacggggccugcccccgguacgucaagcagaacacccugaagcucgccacgggcaugcgcaacgugcccgagaagcagacccgggggaucuucggcgcgaucgccggguucaucgagaacggcugggagggcaugguggacgggugguacggcuuccgccaccagaacucggaggggcggggccaggccgccgaccugaaguccacccaggccgcgaucgaccagaucaacgggaagcugaaccgccucaucggcaaggccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 6620 - RNA, 1701 nt, Artificial Sequence; identical to SEQ ID NO: 5837
  derived and/or modified CDS sequence (AUadapt) from InfluenzaA__ADV76642__HA

SEQ ID NO: 6621 - RNA, 1701 nt, Artificial Sequence; identical to SEQ ID NO: 5841
  derived and/or modified CDS sequence (AUadapt) from InfluenzaA__ADV76664__HA

SEQ ID NO: 6622 - RNA, 1701 nt, Artificial Sequence
  derived and/or modified CDS sequence (AUadapt) from InfluenzaA__ADV76673__HA
augaagaccaucaucgcccugucguacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagucguccagcaccggcaagaucugcaacaacccccaccgcauccuggacgggaucgacugcacccugaucgacgcccuccugggcgacccccacugcgacgucuuccagaacgagacgugggaccuguucguggagcgguccaaggccuucucgaacugcuaccccuacgacgugccggacuacgcgucccuccgcagccuggucgccuccucgggcacccuggaguucaucaccgagggguucaccuggacgggcgugacccagaacgggggcuccaacgccugcaagcgggggcccggcagcggcuucuucucccgccucaacuggcugaccaagucgggguccaccuaccccgugcugaacgucacgaugcccaacaacgacaacuucgacaagcucuacaucuggggcgugcaccacccgucgaccaaccaggagcagaccucccuguacgugcaggccagcgggcgggucaccguguccacgcgccggucgcagcagaccaucauccccaacaucgagagccgccccugggugcggggccuguccucgcgcaucuccaucuacuggaccaucgucaaccccggcgacgugcucgugaucaacagcaacgggaaccugaucgcgccgcggggcuacuucaagaugcgcaccgggaaguccucgaucaugcgguccgacgcccccaucgacacgugcaucucggagugcaucacccccaacggcuccauccccaacgacaagccguuccagaacgucaacaagaucaccuacggggccugccccaaguacgugaagcagaacacccugaagcucgccacgggcaugcgcaacgugcccgagaagcagacccggggccuguucggggccaaggcgggcuucaucgagaacgggugggagggcaugaucgacgggugguacggcuuccgccaccagaacagcgagggcaccgggcaggccgccgaccugaaguccacccaggccgccaucgaccagaucaacggcaagcucaaccgggucaucgagaagacgaacgagaaguuccaccagaucgagaaggaguucucggagguggaggggcgcauccaggaccuggagaaguacguggaggacaccaagaucgaccugugguccuacaacgcggagcuccuggucgcccuggagaaccagcacaccaucgaccucaccgacagcgagaugaacaagcuguucgagaagacgcggcgccagcugcgggagaacgccgaggacaugggcaacgggugcuucaagaucuaccacaagugcgacaacgccugcaucgaguccauccgcaacggcaccuacgaccacgacguguaccgcgacgaggcccucaacaaccgguuccagaucaagggcgucgagcucaagucgggguacaaggacuggauccuguggaucuccuucgcgaucagcugcuuccugcugugcguggugcugcucggcuucaucaugugggccugccagcgcgggaacauccggugcaacaucugcaucuga

SEQ ID NO: 6623 - RNA, 1701 nt, Artificial Sequence
  derived and/or modified CDS sequence (AUadapt) from InfluenzaA__ADV76682__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccucggggcggaucaccguguccacgaagcgcagccagcaggccgugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucgggggaguccucgaucaugcgguccgacgcccccaucggcaagugcaacagcgagugcaucacccccaacggcuccauccccaacgacaagccguuccagaacgugaaccgcaucacguacggggcgugcccccgguacgucaagcagaacacccugaagcucgccaccggcaugcgcaacgugcccgagaagcagacccgggggaucuucggcgccaucgccggguucaucgagaacggcugggagggcaugguggacgggugguacggcuuccgccaccagaacucggaggggcggggccaggccgcggaccugaaguccacgcaggccgccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacaccaucgaccucacggacucggagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggcgugccagaaggggaacauccggugcaacaucugcaucuga

SEQ ID NO: 6624 - RNA, 1701 nt, Artificial Sequence; identical to SEQ ID NO: 3858
  derived and/or modified CDS sequence (AUadapt) from InfluenzaA__ADV76694__HA

SEQ ID NO: 6625 - RNA, 1701 nt, Artificial Sequence; identical to SEQ ID NO: 3656
  derived and/or modified CDS sequence (AUadapt) from InfluenzaA__ADV76705__HA

SEQ ID NO: 6626 - RNA, 1701 nt, Artificial Sequence; identical to SEQ ID NO: 3858
  derived and/or modified CDS sequence (AUadapt) from InfluenzaA__ADV76716__HA

SEQ ID NO: 6627 - RNA, 1701 nt, Artificial Sequence
  derived and/or modified CDS sequence (AUadapt) from InfluenzaA__ADV76727__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaaguccucggccugcauccgccgguccaagaacagcuucuucucccgccugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaggccucggggcggaucaccguguccaccaagcgcagccagcagacggugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccucgaucaugcgguccgacgcccccaucggcaagugcaacagcgagugcaucacccccaacggcuccauccccaacgacaagccguuccagaacgugaaccgcaucacguacggggccugcccccgguacgucaagcagaacacccugaagcucgcgaccggcaugcgcaacgugcccgagaagcagacccgggggaucuucggcgccaucgccggguucaucgagaacggcugggagggcaugguggacgggugguacggcuuccgccaccagaacucggaggggcggggccaggccgccgaccugaaguccacgcaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacaccaucgaccucacggacucggagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 6628 - RNA, 1701 nt, Artificial Sequence
  derived and/or modified CDS sequence (AUadapt) from InfluenzaA__ADV91009__HA
augaaggccauccuggccgugcuccuguacaccuucgcgaccgccaacgccgacacgcugugcaucggcuaccacgccaacaacucgaccgacaccgucgacaccgugcucgagaagaacgugacggucacccacuccgugaaccugcuggaggacaagcacaacgggaagcucugcaagcugcgcggcaucgcgccccugcaccucgggaagugcaacaucgccggcuggauccuggggaacccggagugcgagucgcuguccaccgccagcuccuggucguacaucguggagacccccuccagcgacaacggcacgugcuaccccggcgacuucaucgacuacgaggagcuccgggagcagcuguccucggucuccucguucgagcgcuucgagaucuuccccaagaccuccagcuggccgaaccacgacuccaacaagggggugaccgccgccugcccccacgcgggcgccaagucguucuacaagaaccugaucuggcucgugaagaaggggaacuccuaccccaagcugagcaaguccuacaucaacgacaagggcaagaagguccuggugcucugggggauccaccaccccucgaccagcgccgaccagcagucccuguaccagaacgccgacgccuacguguucgucggcacgucgcgguacuccaagaaguucaagccggagaucgcgauccgccccaaggugcgggaccaggagggccgcaugaacuacuacuggacccugguggagcccggggacaagaucaccuucgaggccaccggcaaccucgucgugccccgguacgccuucgccauggagcgcaacgccgggucgggcaucaucaucuccgacacgccggugcacgacugcaacacgaccugccagacccccaagggcgcgaucaacaccagccugcccuuccagaacauccaccccaucaccaucgggaagugcccgaaguacgucgaguccaccaagcugcggcucgccaccggccugcgcaacgugcccucgauccagucccgggggcuguucggcgccaucgccggguucaucgagggcggcuggacggggaugguggacggcugguacggguaccaccaccagaacgagcagggcagcggguacgccgcggaccucaaguccacccagaacgccaucgacaagaucaccaacaaggucaacucggugaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgucaagaaccucuacgagaaggugcgcucgcagcugaagaacaacgccaaggagaucgggaacggcugcuucgaguucuaccacaagugcgacaacacgugcauggaguccgugaagaacgggaccuacgacuaccccaaguacagcgaggaggcgaagcugaaccgggaggagaucgacggcgucaagcucgaguccacccgcaucuaccagauccuggccaucuacucgaccguggccuccagccuggugcucgucgugucgcugggggccaucuccuucuggaugugcagcaacggcucccugcagugccggaucugcaucuga

SEQ ID NO: 6629 - RNA, 1701 nt, Artificial Sequence
  derived and/or modified CDS sequence (AUadapt) from InfluenzaA__ADV91010__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaccgacuacgaggagcuccgggagcagcugucguccgugucguccuucgagcgcuucgagaucuuccccaagaccagcuccuggcccaaccacgacucgaacaagggggucaccacggccugcccgcacgccggcgccaaguccuucuacaagaaccugaucuggcucgugaagaaggggaacagcuaccccaagcuguccaagucguacaucaacgacaagggcaaggaggugcugguccucugggggauccaccacccgcccaccagcgcggaccagcagucccuguaccagaacgccgacgccuacguguucgugggcaccucgcgguacuccaagaaguucaagcccgagaucgccauccgccccaagguccgggaccaggagggccgcaugaacuacuacuggacccugguggagcccggggacaagaucacguucgaggccaccggcaaccucguggucccccgguacgcguucgccauggagcgcaacgccgggucgggcaucaucaucuccgacaccccggugcacgacugcaacaccacgugccagacccccaagggcgccaucaacaccagccugcccuuccagaacauccaccccaucaccaucgggaagugcccgaaguacgugaaguccacgaagcugcggcucgccaccggccugcgcaacguccccucgauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacgagaucacgaacaaggugaacucggucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggccaucuacucgaccgucgcguccagccuggugcucguggucucgcugggggccaucuccuucuggaugugcagcaacggcucccugcagugccggaucugcaucuga

SEQ ID NO: 6630 - RNA, 1701 nt, Artificial Sequence
  derived and/or modified CDS sequence (AUadapt) from InfluenzaA__ADW01407__HA
auggaggccaagcuguucguccucuucugcgccuucaccgcgcugaaggccgacaccaucugcgugggcuaccacgccaacaacucgacggacaccguggacaccauccuggagaagaacgugaccgucacgcacuccgugaaccuccuggagaacagccacaacgggaagcugugcucccucaacggcaagaucccccugcagcuggggaacugcaacguggccggcuggauccucgggaacccgaagugcgaccugcugcucaccgccaacucgugguccuacaucaucgagaccagcaacuccaagaacggcgcgugcuaccccggcgaguucgccgacuacgaggagcugaaggagcagcugucgaccgucuccagcuucgagcgcuucgagaucuuccccaaggccacguccuggcccaaccacgacaccacccgggggaccacgguggccugcucgcacuccggcgcgaacagcuucuaccgcaaccuccuguggaucgugaagaaggggaacuccuacccgaagcugucgaaguccuacaccaacaacaagggcaaggagguccucgugaucuggggcgugcaccacccgcccaccgacagcgaccagcagacccuguaccagaacaaccacacguacgucuccguggggucgagcaaguacuacaagcggcugacccccgagaucguggcccgccccaagguccgggagcaggccggccgcaugaacuacuacuggacccuccuggaccagggggacaccaucacguucgaggccaccggcaaccugaucgcccccuggcacgcguucgcccucaagaagggguccucguccggcaucaugcggagcgacgcccaggugcacaacugcaccaccaagugccagacgccccacggcgcccugaaggggaaccugcccuuccagaacgugcacccggucaccaucggcgagugccccaaguacgugaaguccacccagcuccgcauggccaccgggcugcggaacauccccucgauccagucccgcggccuguucggggcgaucgccggcuucaucgagggcggguggacgggcaugguggacgggugguacggcuaccaccaccggaacgagcaggggagcggcuacgccgccgaccagaaguccacccagaucgccaucgacggcaucucgaacaaggucaacuccgugaucgagaagaugaacauccaguucaccagcguggggaaggaguucaacucccucgagaagcgcauggagaaccugaacaagaaggucgacgacggcuuccuggacguguggaccuacaacgcggagcuccugauccugcucgagaacgagcggacgcuggacuuccacgaccugaacgucaagaaccucuacgagaaggucaagucgcagcugcgcaacaacgccaaggagaucgggaacggcugcuucgaguucuaccacaagugcgacaacgagugcauggaguccgugaagaacgggaccuacaacuaccccaaguacagcgaggaguccaagcugaaccgggaggagaucgacggcgugaagcucgagucgaugggcauccaccagauccuggccaucuacuccaccguggccagcucgcuggugcuccuggucucccugggggccaucagcuucuggaugugcuccaacggcagccuccagugccgcgugugcaucuga

SEQ ID NO: 6631 - RNA, 1698 nt, Artificial Sequence; identical to SEQ ID NO: 3376
  derived and/or modified CDS sequence (AUadapt) from InfluenzaA__ADW09101__HA

SEQ ID NO: 6632 - RNA, 1698 nt, Artificial Sequence
  derived and/or modified CDS sequence (AUadapt) from InfluenzaA__ADW09111__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccucgguguccagcuucgagcgguucgagaucuucccgaaggaguccagcuggcccaaccacacggucaccgggguguccgccagcugcucccacaacggcgagucguccuucuaccgcaaccugcuguggcucaccgggaagaacggccuguaccccaaccugagcaaguccuacgccaacaacaaggagaaggaggugcucguccuguggggcgugcaccacccgcccaacaucguggaccagaagacccuguaccggacggagaacgccuacgucagcguggugagcucccacuacucgcgcaaguucacccccgagaucgccaagcggcccaagguccgcgaccaggagggccggaucaacuacuacuggacccuccuggagcccggcgacaccaucaucuucgaggccaacgggaaccugaucgcgccgcgcuacgccuucgcccucucccggggcuucgggagcggcaucaucaacuccaacgcccccauggacaagugcgacgccaagugccagacgccccgcggcgcgaucaacagcucccugcccuuccagaacgugcacccggugaccaucggggagugccccaaguacguccggagcgccaagcugcgcauggugaccggccuccggaacauccccuccauccagucgcgcgggcuguucggcgccaucgccggguucaucgagggcggcuggaccgggaugguggacggcugguacggguaccaccaccagaacgaccagggcuccggguacgccgcggaccagaaguccacgcagaacgccaucaacggcaucaccaacaaggucaacagcgugaucgagaagaugaacacccaguucaccgccgucggcaaggaguucaacaagcuggagcggcgcauggagaaccucaacaagaagguggacgacggguucaucgacaucuggacguacaacgccgagcugcuggugcuccuggagaacgagcggacccuggacuuccacgacagcaacgucaagaaccucuacgagaaggugaagucccagcugaagaacaacgccaaggagaucggcaacgggugcuucgaguucuaccacaagugcaacgacgagugcauggagagcgugaagaacggcaccuacgacuaccccaaguacuccgaggagucgaagcugaaccgcgagaagaucgacggggucaagcucgaguccaugggcguguaccagauccuggcgaucuacagcaccguggccagcucccugguccuccuggugagccugggcgccaucuccuucuggaugugcagcaacgggucccuccagugccggaucugcaucuga

SEQ ID NO: 6633 - RNA, 1698 nt, Artificial Sequence
  derived and/or modified CDS sequence (AUadapt) from InfluenzaA__ADW09120__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccucguucgagcgguucgagaucuucccgaaggaguccagcuggcccaaccacacggucaccgggguguccgccagcugcucccacaacggcgagagcuccuucuaccgcaaccugcuguggcucaccgugaagaacgggcuguaccccaaccugagcaaguccuacgccaacaacaaggagaaggagguccucgugcuguggggcgugcaccacccgcccaacaucgucgaccagaagacccuguaccacacggagaacgccuacgugucgguggucagcucccacuacagccggaaguucacccccgagaucgccaagcgccccaaggugcgggaccaggaggggcgcaucaacuacuacuggacccuccuggagcccggcgacaccaucaucuucgaggccaacggcaaccugaucgcgccgcgguacgccuucgcccucuccaagggguucggcagcgggaucaucaacuccaacgcccccauggacaagugcgacgccaagugccagacgccccgcggcgcgaucaacagcucccugcccuuccagaacgugcacccggucaccaucggcgagugccccaaguacgugcggucggccaagcugcgcauggugaccgggcuccggaacauccccuccauccagagccgcggccuguucggggccaucgccggcuucaucgagggcggcuggaccggcauggucgacgggugguacggcuaccaccaccagaacgagcagggguccggcuacgccgcggaccagaaguccacgcagaacgccaucaacgggaucaccaacaaggugaacagcgucaucgagaagaugaacacccaguucaccgccgugggcaaggaguucaacaagcuggagcggcgcauggagaaccucaacaagaagguggacgacggcuucaucgacaucuggacguacaacgccgagcugcugguccuccuggagaacgagcggacccuggacuuccacgacagcaacgugaagaaccucuacgagaaggugaagucccagcugaagaacaacgccaaggagaucgggaacggcugcuucgaguucuaccacaagugcaacgacgagugcauggagagcgucaagaacgggaccuacgacuaccccaaguacuccgaggagucgaagcugaaccgcgagaagaucgacggcgugaagcucgaguccauggggguguaccagauccuggcgaucuacagcaccgucgccagcucccuggugcuccuggugagccugggcgccaucuccuucuggaugugcagcaacggcucccuccagugccggaucugcaucuga

SEQ ID NO: 6634 - RNA, 1698 nt, Artificial Sequence; identical to SEQ ID NO: 3861
  derived and/or modified CDS sequence (AUadapt) from InfluenzaA__ADW09131__HA

SEQ ID NO: 6635 - RNA, 1698 nt, Artificial Sequence
  derived and/or modified CDS sequence (AUadapt) from InfluenzaA__ADW09153__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccucguucgagcgguucgagaucuucccgaaggaguccagcuggcccaaccacacggucaccgggguguccgccagcugcucccacaacggcgagagcuccuucuaccgcaaccugcuguggcucaccgugaagaacgggcuguaccccaaccugagcaaguccuacgccaacaacaaggagaaggagguccucgugcuguggggcgugcaccacccgcccaacaucgucgaccagaagacccuguaccggacggagaacgccuacgugucgguggucagcucccacuacagccgcaaguucacccccgagaucgccaagcggcccaaggugcgcgaccaggaggggcggaucaacuacuacuggacccuccuggagcccggcgacaccaucaucuucgaggccaacggcaaccugaucgcgccgcgcuacgccuucgcccucucccggggguucggcagcgggaucaucaacuccaacgcccccauggacaagugcgacgccaagugccagacgccccgcggcgcgaucaacagcucccugcccuuccagaacgugcacccggucaccaucggcgagugccccaaguacgugcggucggccaagcugcgcauggugaccgggcuccggaacauccccuccauccagagccgcggccuguucggggccaucgccggcuucaucgagggcggcuggaccggcauggucgacgggugguacggcuaccaccaccagaacgagcagggguccggcuacgccgcggaccagaaguccacgcaggacgccaucaacgggaucaccaacaaggugaacagcgucaucgagaagaugaacacccaguucaccgccgugggcaaggaguucaacaagcuggagcggcgcauggagaaccucaacaagaagguggacgacggcuucaucgacaucuggacguacaacgccgagcugcugguccuccuggagaacgagcggacccuggacuuccacgacagcaacgugaagaaccucuacgagaaggugaagucccagcugaagaacaacgccaaggagaucgggaacggcugcuucgaguucuaccacaagugcaacgacgagugcauggagagcgucaagaacgggaccuacgacuaccccaaguacuccgaggagucgaagcugaaccgcgagaagaucgacggcgugaagcucgaguccauggggguguaccagauccuggcgaucuacagcaccgucgccagcucccuggugcuccuggugagccugggcgccaucuccuucuggaugugcagcaacggcucccuccagugccggaucugcaucuga

SEQ ID NO: 6636 - RNA, 1698 nt, Artificial Sequence; identical to SEQ ID NO: 3861
  derived and/or modified CDS sequence (AUadapt) from InfluenzaA__ADW09164__HA

SEQ ID NO: 6637 - RNA, 1698 nt, Artificial Sequence
  derived and/or modified CDS sequence (AUadapt) from InfluenzaA__ADW09186__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccucgugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucguggaccagaagacccuguaccggacggagaacgccuacgucucgguggugagcucccacuacagccgcaaguucacccccgagaucgccaagcggcccaagguccgcgaccaggagggccggaucaacuacuacuggacccuccuggagcccggcgacaccaucaucuucgaggccaacgggaaccugaucgcgccgcgcuacgccuucgcccucucccggggcuucgggagcggcaucaucaacuccaacgcccccauggacaagugcgacgccaagugccagacgccccagggcgcgaucaacucgucccugcccuuccagaacgugcacccggugaccaucggggagugccccaaguacguccgcagcgccaagcugcggauggugaccggccuccgcaacacccccuccauccagagccgggggcuguucggcgccaucgccggguucaucgagggcggcuggacggggaugguggacggcugguacggguaccaccaccagaacgagcagggcuccggguacgccgcggaccagaaguccacccagaacgccaucaacggcaucaccaacaaggucaacucggugaucgagaagaugaacacccaguucacggccgucggcaaggaguucaacaagcuggagcgccggauggagaaccucaacaagaagguggacgacggguucaucgacaucuggaccuacaacgccgagcugcuggugcuccuggagaacgagcgcacccuggacuuccacgacagcaacgucaagaaccucuacgagaaggugaagucccagcugaagaacaacgccaaggagaucggcaacgggugcuucgaguucuaccacaagugcaacgacgagugcauggagagcgugaagaacggcaccuacgacuaccccaaguacuccgaggagagcaagcugaaccgggagaagaucgacggggucaagcucgaguccaugggcguguaccagauccuggcgaucuacucgacgguggccagcucccugguccuccuggugagccugggcgccaucuccuucuggaugugcagcaacgggucccuccagugccgcaucugcaucuga

SEQ ID NO: 6638 - RNA, 1698 nt, Artificial Sequence; identical to SEQ ID NO: 3376
  derived and/or modified CDS sequence (AUadapt) from InfluenzaA__ADW09197__HA

SEQ ID NO: 6639 - RNA, 1698 nt, Artificial Sequence; identical to SEQ ID NO: 3861
  derived and/or modified CDS sequence (AUadapt) from InfluenzaA__ADW09208__HA

SEQ ID NO: 6640 - RNA, 1698 nt, Artificial Sequence; identical to SEQ ID NO: 3861
  derived and/or modified CDS sequence (AUadapt) from InfluenzaA__ADW09219__HA

SEQ ID NO: 6641 - RNA, 1698 nt, Artificial Sequence; identical to SEQ ID NO: 3376
  derived and/or modified CDS sequence (AUadapt) from InfluenzaA__ADW09230__HA
